United States Patent 9,567,581 (SELECTIVE REACTIVATION OF GENES ON THE INACTIVE X CHROMOSOME) - sequence listing, part 53

SEQ ID NO: 5616 - DNA, 822845 bp, human
atgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaaggtaggattattaaagctattacatcattacaaatacaattagaagctggccatgacaaagcatatgtttgaacaagcagctgttggtagctggggtttgttgccgagctcttcaaactctgcaaacagtgttgcttttacagaatggattttaaaattgccttgtgctgcgttagattttggggagggggtgtgcttgcctccaacctcaggaaaacacttctgggatagaaatcagtgttagaagattttagaataaagtattgttcaggagtctaggtttcttcaggtagatgatgacagggggaaaaaaatcttcggggaaatctaccccagattagttatatgcaatttagttgcaagaactgattgatgtattggcatattcagacagtgagagaaatgagaatgtacagaatgtttggataggttgaaaattgttatacttggtttctattttataaggagtttggctgtcagtcatttctcctcatcaatttctagcttttgacatttattcagtcattctgcattatatgaagaaaatatatcaatatctcctgcagggtttttcaacaactctagcatctgtttcagctattgaactgtattcacgttttgccaagttgatgtcgacccagctggtctatgatttctcgcttgattactgctcttaatttctctgtatcagcttgtttcagatagggctttgaaggctgttaatgaaaaatgacagaagtgataaattattgaaaatgtgagcatttatttatttatttatttatttatttatttattttgccctttaatgagttttgtcttacattctttcttgcctgcgtacgatttttagaaccctttctctgttttgcaatatttctttcccctacaatcagtggattataattataagtacttttaagcaaatggagcatgagcatggacagtatttggctccaaaaataaagtttttggagaaaggggagcaatttatgctttttgtataaactatgcatcgtttctataacctatcttcacatgctgtcatggggatctgtcagtgactgtaatcagactgaacatattgaaataatctttatcaccactagggtaacaagcaaataaaacattcaaacatttaacaagtgattgtttaaaacagatgttaaataatatagaaatagattttcctaagtgtgaaaagcctgattattaactgtctatgtaatacagaatctttcggctctctacccagtctcctccatagcctgaggagctaaatcatccaagttaatagactatcatatatgtacatctaatatgacctttcagtgtacacagtgctactcgtatgtgctgtgccttttctgtagtaattgtaatatcccagtcagtctggttaaggaacactattggctgttatgtaactttttttctgaatgttagtccatggttttcaattacgtattcctcttagaaagggtgagttaaaaacaacatgtatttaaatatcagtaaattaattagcaagtggtgggctaattacactaggatttctccaaaataattgctaacttctgttttgaaaaatagtcaaggatttggatgactactttttaaccttgaagcatacattaccgtggttgaatatcattcataattcatatatacagcaggaaagaaaatagttttctagatgtatcattttagcagcaaagaatttttttttataatgtggttcaggcactctgattatttccgtttaatacttttaagtactgtagatgcttttgtatagtgtgttacagaacttggttaatctttgggaagctcaaagactgacagaattttgcatccaaatgctacagggttattttgtggttggttgagaaaattcagctctgtctatactgttgtttaaaatacagccctctttggccaatgttacttttcaactttttataaccgttttaagtgaccattcaagactgtaaaaactcttttacactgcatctttagtaggactctccttttgtgaattgtctccttcgaaaaaatgtgagcttccttctagcctcactctcttgttaccatagttacttttaaaagaaggtttttctttttcaatgaagatagcgtactttaaatcagccactggaatccccaaactgtgtttttgtattttttagtttatagtttaggcttgcttcatttgcggttagaaagtgctctgtatttggtcccactgatgaatggattggacagacgctaggtggcaccagctgttgattattaatgaaatcgtaaagtctatatgccacgcacctgaagagcaggcaaacccttattgataaatgcattgtaagagctggaaatgtctgccaatatttcttgctctaaaacagggtcagcctgcagagtgatgagaccacgtgaagtcttcaaatcccaattgcttaatcctgtgtcttctgaagtgctttaaggaagaaaaaacgatgaaggagaaatgcataaaaatagaaggtgtgaaagagaagtgggacacaatgaaatagactgcaaacattttaatatatttttaaatccagaattagtgacttttataaatctatgtgagttttccccaattctctcaaactcagattgttttctctaaggcatttatattctaaaacaattatttatctcttttaggtaaaaattttattgagcatcattattttttaagtaaaaaaatctcccttatttctctttttgtgataagactgtcaagtgaaatttcccacatgagctagagtagctgcctctcaggtgttgctcttcagaaagatgagcaggggaagacactatcggttaagaaatatgctttgaaatgttttgcctgagaagcttgctccatcctattatcctcccattctcatataatccatcttttaagaaggaaaaagcaaataaaaacaaaccacttaagcatgtgcatacacacacacacacacacacacacgctttggaaaaaaaaaaaagtcagaactgtttaaaaagagaaagccacgacaatattttagttggtcctggagttaataaactaaagtgaaaaataggaaggaaagtccataattagattgtggagagtaaataattacttaaaactggaaatatttttccagaaaaatatgcaatattttttcttcactgggagtaactgacaattcctgaagaaggtgagatggtttagaaagagtgcaaagataatatatgctgtgattctccaatgttatctgaaaagtatgtaatatggctagttatcttgattatagcatggactttggtaaagatttttatgatgcccatatggtgaaaatggagaaatatttgctgtttgacataagagtctggtcaataaatcagctggctaaatgaccctgcctgtgatgtatcaattaatgaatcacagtaaaccaggaagagggcctttcacaggactatagcatagttctataaaattggttccatctgacttgaacctaatcttctgtaatgtgccttatgtctctgttcttgaacctacttggcctgtgaaatattaatgtccaaaaactgaaggacgatccagatagcctgtctatctgggaagcagaacaaatacattgaactattagggtaccaaaggattatgaccacctaaaaactgtggtgaggtcaaagagaataattgtaataggaataagtataacatcctaagctaaggttcataaaatcaatctggcaagtacaggacatgagagagttaaagcttagtaataattaattgaataaatcttactgattttgttggtcatcattattatcagtcataattcatatgacatcaaaatacaatgaaacaaagtaatattgttagacatgtatcctgaaaaaggaaatgaaaaaaatgagaacgaattttagaaggatatatatgatataatggtgtgtgtgtgtatatatatgataggtatggtatatgtatatattatatgtggtaatatatacatattttagaaggacaccatgatctaagaggaaccttaacatttgggggtatgttcagtgaaaagtgtctgaatgctaaaaggtcctacaaactataacatttgaggggcatggaaagtactagaaaagtgaaaagttgaagaatacttgaaggaaaaaagtagagaaaattaagctgatttcaaatattcgatgtgctataatgcagaagagggtttagactcacttgcacctctttggtagcaatggaaaagtattcttccagttaatgttgtgagcagagaattgattactttgtgagacactgcactccttattcctaaagtgttcagtgctaagaatggagtttctgcactaaatggaaattgaagaagatgtctgagataatttttaactaagaatctgtgagtccaatcatttcttttaaaaacatgttcttttttttagacatttatttctctgagggtctctactactccactcgcatcatccaggctaggggtcagtaaatgatagtccacattgtcacatctattactgtttgaccagtcatttaaaatggttttcacgtttctgaattgtttcatttcaagaatatttctgacacatgagattatataaaatttcaatttaagagtctatagtttatttggaagacagccacacccatttatttgtttatatgctatataggactcctttcatgctaaaacacagttgagtacttatgacagagaccatgtgggccacaaagcaggaatatttactatctggccctcgataggaaaagtttgctcacctcatctctagactataaagaaattttgttttttgcttattgactcaagtatctaaacaagcaatgtaacagttaaataacagttctataccataaacagaaattgtaaccacccatactacttaagtactagagacttggaaaagtagttcaaatatgcagcctaacagataaagatggtttcatttggctgttagtctattgagataatttacttgttgaggaatgtttatttaatgtttccataaaaaattgaagtctctgcaatcattgacttatatataatatctgcctagtttgactccattaatcttgctgaatttacctatttggtaggattctgttatttttattgctgcttttccgttagtgtatgatttcagtagacttacagaaagggtgaaagtcaatggaaaacaaggtaaagtgagtggaattttcttcttgcagctaccctcttctctcttcgtgggtttatagactctctcagcagctttggaattgcagttttagagacttacttttataacattatgagtgtgttcttgatcaaatatgttctagaagggatcaagataaaacaaatgcactgcactataaaagaacagttaagggttttagtaaatgattgataagacatgctaaatttaagaattagcaatgagttatttatattttcctgaacatagggatatgagaagggattttttttcatgtcataggagaaactataatcaaattctaagcataaagctgagggattctgaatttaccaccaaatattacaatctccatagttccataatgtgcaactaaaatccccacattttttttctagggaaagatataatttctgctcactggtagcgctggaaattcctgtaaaacccataggattcttattgtatttccatgaggatgttcctgagcagctactttgtgatgcctgtctctatggtaacagacacaaggcttaagggtctgaaagaaattcttcctgttggcttaggaatatggagcaatgagggagacccactgaagactataaaactgaggaaaggcaaaagaggcaattgagaaaaagttgtcgtgggggagctttttttgtgtatttgaaaataatttcacaatttcatttgctcttaatatatctctgaatgaaataagaaccaacatacaagtaaagttttacagaaagaaaaaattctgtgaaagtattgttttttaaccatctagtcaattttatgtaattgaagtcacacagattttttctttagttggcttgcctttcgctactcaagaaaagattgcttcttgcctgaaattggtaagaggacggctctacccctggcaaatttagttcttgttactgctatcaaagatcttgatcttttaaaggactttctttttcctgattccaagggtaagaatattgaactctggttcacattactcataatcactgagcttctcagggaattatgaaagtacactagccttccaagatgttcttttttaggtctatttctcttaaagaccagtaataaatagagcaaatagtactgcttatttgaaaattgggtatttcgtaagaggatgctgggtgagagtttgtgtttttacatgttttactttgtttctcttattaaaataacaaaaaagcaaacaaaaagctcctagaagtttaaaaatatttgattttccatttatttgacttcatcttactttcagcttagcaaatagggacacatcacatttgaattgttttagaaaggagataaatatgactctcctttcccttagattcaaagtatatgttcaaggtgtcatcaaatagccaaaagtctttaaaatatttatgctatgtaaatgtccttcaggaaaatataagtcagagggaggagatggccgtcttagtataaagctctcatgtgtatttgcagtgttaacatgagtgttgatgttttatttatcttcttaacatgttatatctgcacatgtcttcatttgttatatgttagggtcaacagaaaaaataataaagttattgcaagtaagcaaaaacttataacctgatcaataaaaattaatattttaggttggaagataaacacatctcaaatgtcattttataagatcaagttaacaaatgttagcatgcttaaagctttagaggaattaaatctttttatggtttattttctgaccttgagaaatttatagactctgtgcagatatatgttttcacaaatttaatccactctatatagatattagtaaaatgtaagacagtgtcttcagtacctgttcacactatctttaaattaaatgaaaaaactcaagttagctgtaatgtttcagtgtctcctttgatagtgttggaaagcaaattttttaaagaaaaccttttttataactccatacattttgacctatagatactaattgcaatataaaatgtgacatctgaataaaacaagaatactttaaatattcaatatatatactacttttgaaaagatgacttaaattataaacatataaattatatgcctaacatgactggcttccaaaaaacttattttcttgagctttggggttacagcctaaagtgcactgcagtaaataagcaaatgggtaaaaatattgtctagacaaaagtaaaactgagatgttcttttgagcaaacgtttatagaggaggtacaggatgacaactggaaacgtaggtggtacgcagagattaattgctgtcaatgtacacctgaaggtaaatggatggtgcttatcaaatttccagaagaaatattgacattatgttgcaatttgaagacagggttatgaatacaaagagctaagggaaaataaacttatcagcatcattcagctctggtcatgacattgttacaactgattataacactcccaggataaaatgtgataaggaccatcatagtctgtttttactagtacagatttcttttatacatgctataagtagaattgttcggtccagcaacaataagctggattattgaaagtgacactaatgctaacctgaaattgtatgggttttaggggagatgtgggactcatttatgttctatgacaagtgtaaaaaggagattaagtaaaagcctgcatgtgatggacacattagtgagtaggaatctcaggttcctctccctttggctgctgacccattcatgggctggttttggtggccacagtggcaggaaacagagtctatttctccattaggtcatccagacaggattagagcccaccaactgaaatgaaaggttgtttctgctgcttttcattcatccaacaaatatttattgataaattctaactgccaggctctgtgctagagcaagatgactaagatacagtccctgaggaatttagagacgaacgtggtttatgtggatgagaagagaaaaatatttacagtgaatagctaagcagagagcaacagcaactgtgaacccagacagtaaagctgacttaggactgagctagaggtttccggagttcctagtgtgagtgatgtggaaaaactggcaagtccatcaaagagcaaaatgataactgaacagaaagaaagcaaatccagtgaaaaatagtaattcaaagtaaagggtaaagcgacatatttgaagtgtcacttgaaataaaaaggagcatgccttccacctgttgctcatcttcactggaatcaaacctagaaggaaaatgtctaggctggtctaaaagccagttgcatacaatgatattaaatatgattaaagctagcatgagcatgaccatgcaaactttcaggaggatttgaaaacagttacctcccattggtagtttatgtacgtctatccctggaaactttttcctatgctatctttagagaccttgtcatattttatctcaatgtctaacactctttaattagaagctacctgaaaatgtttcactcatgtataaagttaaattaatcacagaatcagacctcagaggttacaaaggagggctgaaaggataacatctcagatagaatagatctattgccaaataaacctgtaacaataagaaattgtgttagataatccgtaaggttttatccaatttcaacatcttccaatttaattgatctccagcctcacacccaactcctcctaggaaattaaaaagagacaggtaaacaagatattttctgaagaatcgaatcatccagaaagtcattctctctcaagcagtacattttctaaagaatttaattatcgaaaaaagtctctctctctcctctttctctctcccttcttctgacatatatagatatgcatatatacacatatatgtatatatttatctatatatctatttatatctctgactcgctgaagtaacttagatatataggctaaaggcaaagaaaaattcctcccaacattcattagtaatttccctttatagattaaggaaagtatttctgtcctccttgatttttaaaacattttactgaactataacacgaatatataaaagttcacaaatcaataggtgtccagcttcatgaattttcacagattgggcacaccccagtaattactcaaggcaagaaaagaatattaccagcatccaaaaactttgtcttaccacttcctagtcaatactctcccagaggtaagtggaatactgacatctaacacaccattgattaggacagacagttcctgaaatgtatgtacttgaagccatacagctgtactcttttgtttctggctcctaaatctcaacattctgtttgtgagatctatctaatttgtttcttgtagttgtggtcccataattttcagtgttgtgtagtatgccatcatataaatgtcctataatttacttattccatctactctggatgaacatttaaattgattccatttgtgaactcttaaaaataattccactttgaatattcttgcaaatttactgcacatatgcatgtagttctgttatgtgccaagaagtagaattattaggtcatagaatagtgaaatactcatctttagttgaaaatgccacgtagtttttcaaggtaggtaaacaaagaaccatcattactttatagaagttctggacatgtcaatgcttagcattattagtctttaatttcagcctttctggctgttatactatagtatctcattgtgtttctcatttccatttttttctagtgactaattaatttgagaaccattttttgtgtttattgctcatgtggatgttatctatagtaaggataacatttcctcccaactttcattagtaatttccctttgtagattaaagaaagtaattctatcaacttgatttttaaaatgttttactgaactataacacaaatatataaaagtgcacttttctaatctcatgctcatttttctattgatttacaattttggtttttataggtatgagatctttacatttttatatggtccctacatttattgtatgtgttgcaaacatctagacagatatcttttataggaacttagaatttcaaaacccggagaccattaaagaatatttagtcccatatcttagtttgaaagatgaggaaagtgtgacttatagagaaattgtcatttcttttaagtttcttccagttagtagtaaggccagatacgtaataaaagtctcctgacactgaagtaaagggtttttttctagtaaaccatgtagggtctttagtcttgtctaatactgtgactcaaactccttgtctcttttggaaggccacaaaatgcgtgacatagtaattttaatagcaagtatagagtgatgcgtgattaatctcattgattttgtgaacaaaaatatcttcagctaacaaactgttgtatagcatggccatgcaatatttaaacctgtatgggccgggcgtggtggctcatgcctgtaatcccagcattttgggaggtcgaggtgggtgtatcatgaggtcaggagttcgagaccagcctggccaatatggtgaaaccccatctctactaaaaacacaaaaattaggtgggctcacgtgcctgtagtcccagctactcgggaggctgaggcagaagaatcgcttgaacccaggaggctgaggttgcaatgagtcaagatcgtgccagtgcactccaacctgggtgacagagtgagattctgtctcaaaaaacaaaggaaaacaaaacaaaacaaaaaaaacctatatgttcttttcggcatcagattttatttttcctctttcataactttattattatattcagtttcttttcacatttattcttattacttggatgttcccattccaaatttggttctaattcaaaaagttttcattttctatagtggatgaagaacaacataaattttacaatactttcttttagtgagataaaatttagtttacaaaacataattactagtacattaatatttactatttatttttaacatgctaggtgcagttcatgcgttattttagctaatctttggaacaacccccgccaaaatgttttattatgcctagtttatagatctagaagctgagcctaagtgagattaagctacttgtgaaacagctctaatcagaaccagatctttataagattctatgcatttcactccttccatgatctacttctgtacctgcttggaaggaaattgagttagtgatacagatttgggtcactacctgcctttagttcttctgccatacataggtcttagggataacctctttttccaatatcattaaataattcattttctgtatcttttttttccaaaacggtaattagagaagtcacttcgttggccttgattttattcattgtattgaataaatacaattttctaaatacggaactcttattcatgtgcaacctaaatacggattaggtgagttaatatccagagaccagattattactaaacttttcttgcatttagagactgaacttattataagaatcttttaattctttttagcaacctattccaaggttgattacttctcatgcatattttagttccaaatatttctttctctttcttgttcattggagaagcattccacagatgcctgagaaacaacttgctctcagtctctctatcttctagtccttggctagagtccccttgccacacttccctagcttcatgcagagtagatactcaatagtacttccacttagaaatttaaatccagatgagttacctagcatgctactttcctcttaaggagtaagtgaagcaaatgtttatagttgtttcactgtatgtgaacaaataggaatgtcaataaaacaagtacatttaattcataagtacttgataatcttaattccttaaatgtataaagctttaaaattaacaaaatactttcaagtttaatttattcacataggaaccatatgaggtaagcaaggtaggaagtcttatttcctctttatagagagccatgtaactaatttctcctatttgtatcctaaatttcttttagctctgccatcccccctccatatctcctgacagtcaccaccttagtttagatccccatatctgacttcgaatacactgatagcttcctaatgtaccttccttcttgcttctctccagtttacccttcacaaggctgctaggcttatctctctcaaagacaaaacttaataagttattccactgcttaaagtccacaggtggctttatattatttatagattataattcaaataacttgcatgaagagaaggtactttacaacaatttccctgccatgtgctcagtctaatcttatatccaccatgtgaatgcctcaccctagccatacaaacagttctctgactgtaacacacttccttttcatgtgcctttggaaatgttgactccatcccacagtcataaacaattcttattcacatatatttacttggtacatgctttataatcctccaaaatagtgtagctagtgcctcttctttacttttggctgaatcatgcacccctgtgcatagaatcttcctaatacttgtttcaccacttattttgctgtgatgtacttttcaggttattgatttattcataaactattagtgcctgagggccatgaattctctattctttttttttttttaccctttgcttagctcttctggagggagctactcaagtttaacttaaagtagtaatgagttacacagccagtaagacatttgtttgagtcctaaggtgacatcatttccattgcatccttcttccctctaatattactaaccatagtacacgagcagtactattgtcaagattcctcctcattcagtttagggaaatgcgttgacccaagttaccatttttgtctatttcacaccgtaaaagtcgggatatttagttatgatggtatgatagttaccctacatggtattttaaaggctctatttcctttgtgacttacacatgacctccccagaggtcttaatttaatggaatcatcacctaaaataatagaagagtaaattgacagtttcgtttataaggtacatggattcaggcatattggtaaagtaacacaaagcaaaaatgtggttcttcatttgtcttgtttcatcactaatagaaaatgatggagttcaccaatcacccaattgtactgtgcagcatggttattgtaaagtatacctgaaattaaaagcaaatatctacttccattttttccactgaattttcatcagaaaatgagaactacatactgaaggatttggggttggcgaatagcagatgtataatgccagcaatatgaaagcagagcaaatgcgtgattggtttacagcctcaacttcagtagtactctgcaaagtctgccagcacacaggtgccttgaggctgcaaagagcgtaggaattcagtggatgtatcaaatgatatgagatgttaatacctacttccttctaatgcatagctttgtgatattagaaaattaataaagaagtgaacaaattaattactttataatctcctaaatcttctctgtggaaggaaaatctcaaagatgcattaagtatccagcaaattggttttgaaattatccattattaaaaagcacaattctgtgtaacaggaagccacatgccaagagctatgtatatttaatcatttatgtcgatgctttttgtagcaattctgtttattctctattgacattatatacagtcctttttatacatagtggaatttaatgtgctgtgtttaaaagacacatcaagcctgacagaatccaattgtatacattatacttttaatttattagaaaatgaaatgatcatttgtgggcttatattagccaaagcagaggataaattttattatattaagaaaatcaaatactgtgactacatttacaaacattgtaaacatgacacttgttgcataattaataaatgaacatattgacctttaatataaaacggcatgaaaggaaagggaaggtggaagatataaccacaatcagaagtggaaatgaactcaaaatctgtaactgtatattaaagaaacatgtgattcatgattgcttttttgccttttccattttgaggcaatagtgccatgttgatattcatttgtgctgtcaaattaagggaaaacattgacaatctttaatataacaaagatagagaataaatgcaggtcaaaagtgtgtgggagaataagagaattgatcacattttaagaacaattacccatgtcactgcttaacccaacgtaatgatgtcaaccagtaggatggaagccagcatcaggaagaatcattttccaagcagatggatctgctgatatttttaattgattgaaggagcgttccattatttttaatcaaaaactaatttcaaataaaatggaaacttccatgaagtttgcaaaaatctgtatgcattaaggctcagactaatagaactacaatgttgtgatagttaataatccattatttaattataatgattattgttcttaacacattacacatgggagtttgtgggaactaccctacctttcttgcttctcaggtgagacaaatcattctcctagtggtctcaagtggtactgaacctcattttatcactgatgacatgctcatgaaactcacactgtactggtgttcttttctccgtctcactcacttctttgctgtgcttcctgggatcacctccgaaataagttgctggcactcaaataatttgctcagggtctacttctggtaaaaggcaacccaagacaacatgatattttattattaatagttttcctcatttaattttatatataatcatttttttctgacagggaagtatatttgaggaaataatgagggcaattatcaaaatatgcattggtttgggagttagagaaactgtcagaagtgacacaccaattttgctacatcgtgacttggtaacagtcattaccattctgggccttttattctcttctgaaaaaatggaagcattcgattacaaatcattaaagaataaagaagatagaaagtgatagaaaagataacaaatgttgatcacaccatgtgcaattgcttgatagtagtttccaggagtactataacagactgagactgtatctacttggaactcgtgggataaaataccattatttgatgccgtatgtgctcggcatgaatgcagtgggaaggatagaaaatatttcatatatttgccaactgtagaatatactgtaatagatcaagtttcattttaaaaatacacaggacacatttttttaaaaatctcatatgaaagcccagcaaagaaaagaagaattgaaggtgtagacatcttgaatgaaaacaagaggacgatttgattcaactgccatttattccaactttcaccctataaccccatagacacagctgtagaaaactgagatcttgaagaaagccactgaattagataatatctacgactacttccaactacaaatgtagaaataattgtctttacctactcatcctcagctagaaagcagctaatgggctactttaaatgtgtgatgctttcacaaattaagcaagactgagtacaacaagcacaacaagtccaacagcacaagttttcacaaacagtattggatgtaacaatacatccaaccagtattagatgtaacaaaaattggttaatttcctaatcaattaattaggaaattttattttctaacctgttggttgccagttatgggcttaagatggaagccagcatcaataggtttaaataatacctttgttttaaaaagaagaagtctaattcatagtcaaacatgtgctttggctaagtggctttgttctgggttttgcatgacagctggtgataaattgggaaaatgtgtaagtagcactgtggtaaggataatgttgatgaagatagaatgtttgaggccactttcagggagaataaaaacgacataaagtaatacttaagactgaattttcttagagatgataatctcatcaccaagcctcattttgccattgaaaaatttcttatgaattcaactatcatatttacatcacaatagacagtattataactctttagcatagggattttgctttaacttactttcaaccaatttatatgttaaagctatttatatctctgctgtttcatgaataaagcccagaggtatcttctttcttgactcactgtcatatcttcacatttcatcacatttttgcagttcaaatatcattcacttagtaacactgaaagcatagaaagattaatcagaaatgatttctgccctcaacaagctgacactggttagagtacaaaagccacactgaaagaatatatggagatctatgatctatgatcaatgatctttgaagttactattgtcatttttgggggcaacatgagtcatgcccatatgaaataacaaacttaatcaatgttgtgtgtgttctgagtgctctaccaaccggccacccccacccccccacatctgtctccctctccttggacctttctattctgagacaaaccaatattgaaatgaagccagttaacaaccccacagtggtctctaagtgttcaagtgaaaggaagagtctcacatgtctcatcttaaatgaaaagctagagatgattatgtttagtgaggagggcatgtcaaaagctgagttaggctgaaatctaggcgtcttgcaccagacagttagtcaaggtgtgaatgcaaaggaaaaattattgaaggaaattaaaagtgttacccccatgcacacatgaatgaaaagaaagcaaagcagtcttactgctgatatggataaaatttaaatggtctagacagatcaaaccagccacaatattcccttaaccaagagctaatccagaggaagatcccaactctcttcaattctacgaaggctgagaggtaaggaagctgcagaagaaaagttggaagctagcagaagttggtttatgaagtttaaggaaagaagccacctccaaacataaaagtgcaaggtgaggcagcaagtgcagttggagaagctgcagcaagttatccagaagttctagctaagatcattgataaaagtggttatactaaatgacagattttttatgtagatgaaatagccttctatttgaagaagatgccatctaggattttcatagctagaaaggagaagtcaatgcctggcttcaaagcttcaaaggacagggtgattcttttgctagagtctaatgcagctggtgactttaagttgaagcaatgctcatttaccattctgaaaatcctagggcccttaagaattatgctaaatagacttagcctttgctctataaaagtaacaataaagcctggatgagagcacatctgtttacagcatgatttactgaatattttaagcccggggttgagaccttgtgctcagaaaaatatattttttttttcaaaaatattactgctcattaataatgtagctggtcatccaagagctcatttggagatgtacaaggagactcatgttgttttcatacctgctaatataacatccattctgtagcccatgggtcaaagagtaagttcaacatttatgtctcattatttaagaaatacatttagtaaggttatagctgctgtaaataataaatcttctgatggatatgagcaaaggaaattgaaagccttctgtaaggaattcaccattctagatgccattaataacattcatgattcatcggaggaggtcaaaatatcacatttaacaggagtttagaagaagctgatttcaaccctcatggatgactttaaggagctcaagttgtcactggaagaagtcactggagatatggtgacaatagcaagagaattaaaatgagaagtggagcctgaagatgttgctgaattcctaaaatctcataataaagcgtgaatggatgaggaattgcatctgatggatgagcaaagaaagtgctttcttgagataaaatttacttctggtgaagatgctgagaacattgttgagatgacaacaaaggatttagaatattacacatacttagctgataaagtagtggcagaatttgagaagactgactccaattttgaaagaagttctactgtgagtaaagtgctatcaaacagcagcacatgctacaaagaaatgttttgtgaaagaaagagtcaattgatgcagcaaaattcattgttgtcttattttacaaagttgtcacagtcactcccaccttcagcaaccccaccctgatcaatcagcagccatccacattgaggcaagagcctccactagcaaaaagattacaactcactaaaggctcagatgattgctagcttttttagcaataaattatgtttttgttaaggtatgtacattttttaacataatgctttgcacacttaggctacaaaataatgtaaatataacttttatatacactgggaaaccgaataattcatgtgactcactttattttggtgatctggaactgaacctgcagtatctccaaggtatacctgtacatattcattcaacttttaccctctaacccgcttacttctgtccctgtggctattgctccaacatcatgataaaaacaaaacatcacatagaagtatggcaattgtactaaacgtattgtaccattggcatttggtgtctgtcgtaccatcacaattgagcctcatccttctttgttaacgcttaattcagagaaaattttcattgagattttataaatgagtaatatggctctgattattgccctgtctgactgcttttatctctatacaatattgtgagagttgctaaagagacttctgatgctgccatatatgtaattggatatttttaaattccatacagtcatctaactgacctctcacccactcaccaaaaattacaactcactccatttgcataaagtaaactgtggaaatatatatattttacctttttcaatctaaattattgctcatggagagtctatttcaccacaaacaatgctatatccttaccttaatggagtattacaatgtaattagccatggaaatggaaaaaatgaaagaaactgttatgaacacatcttcccttttaagccaacttgtcagattttgatagaagaaaaactttcaaagtcttcttacgtgagtcaggtcccattttcttatatttgcattctgctagatttacatctgtctatgacgatgatagtaaaggtgataatgatgataaaggttatgcttatgataattcctcataatgggtaactgtaatatcagataatacacgataagatctttaaaagaaagatgacaagtgaatctcataggagttcagagcatggtgaggatggccctgatttttcatttctgtctctctagtgcattttcatacacactcatcatgggggaggagggcactcaactcaattcagtttatgggatttcatcccagatttctaaatacattatacttatgactctgttcattatcccacccctcccttctctgattatggatgtagtgatgctgattatttttatattcttcactatgaaataactatcattcttcatccatttgggcttctataaaaaaaaataaataataaactgggtggcgtaaactaaaaaaataataaactgggtggcgtagaaacaacagagattcattgctcaaagttctggaggctgggaagtccaagatcaagatgaaggcacactctgtgcctgatgacagaccgtttcctagctactagatggtaccttgttgctgtgtccttatatgatgaagaggcgagctggctctctagggtctcttttataagggtactaatcccaaacaagaaggctctgtactcataacctaatcacaacctaaagacctcaccccctaataccaacctcttggggattagctttcaacatttaaattttggaggaacacaaatattcatactatagcaacattgcaagcaaaattagaataatgtattagtactgttgtgtgggatataacatgagcatgttaagaagagaatcactggattttggaatgtggtaaggccaattatctaattctcaggggaaaatactcagtaagactgaggaagtaggccaggcaaggtgactcatgcctgtaaccccagcactttgggaggctgaggcaggtggatcatttgaggtcaggagttcgagaccagcttggccaacatggtgaaaccctgtctctactaagaaatacaaacaaacaaaaaaaaaattttgctgggcatggtggcacactttagggtggctgaggctggagaatcactcgaacctgggaggtgggggttgcagtgagcggaaatggtgtcactgcacttcaccctgggtgacagagcaagactctgtctcgaaaaaaaaaaaaaatacactgagtaattaaatgtgtaaacatcattttaaaaaaacttttaaaactagtttttaaacttttaatactttaaaattttaaatcatctaatcgaacatgtatataaagatcaaaacaaattaattgtttcagtagaacagtggtgcctagagaactttatttctctggacccaattattcttaactcatcaaatcatatatatatctgtttattcatacgccactccatatatacctaagatagatacatagattgaatcatatgaatttgctgatattggtccattttgaccaaaaaatgataagtttttaggattcaaactaatagctctattactgtattgattaagtggagtgataaggtaccagtgcaatatgttatcactccacttaatcagcacagtaagcccaagaaacataaaacataaagaatattttagaaaatgatgatgatgatttcattttatcaaagctatatgctcctttactgaaatcagacaagggaaaatgttcccttctgtagaaactttattaatcccttatgatcttaatactgttaataatggactagactgtaaaggattaggtaactgaggtgttcaatatggatacttgttttatgtttaatcaaatttatctgactctaaataaatttggctgaaactagacagattccttttctattgagacagtgggctctattaagcactatgtctgcataggaaacattacaattaattttgcagtgacaatatgctttttaactaacagactaatggaaggaggactgatgtaaagcataattctcaaaaagaggggggtaaaaccttggtttctactacaattattcattttatagtattgtttgataacacatactttattaaattgtagatgcattgtaagtttttatagtatatgggaatctaaataaaaggagttatttggttgttatgccatatttagcataaatattaccatccatgtatgttgttgacttaaaacactgttattttctaaaatgtaagcatagaaaaagaataaaattcttagttgatattgcagaaatatattgtagtgtttgcagcatgaaaaggttttatatataataatatacacttaataattaatttccaaaggctgcctgtggtcagccttctttgaaagcatggattctggcaaatgagcaatataatctctttaagaccatttaagctcttaatctcttcaaaccagtaccaaagtctgttcattttgttgtaatagttattgtgtattgtttctttttaattgtgtaagtgagattcaacatcacttgtcagataagaaaaaaaaccttcaaaataaacgttaatttttcccattattgctagaaggaacttggcgtttgaaattttagatattcttaaaatttctttttaaaaatttagaattaaaaacacaaaaagaaaaaagaaaaaaatagcatttactattattccccaaaaatgaaatagtaagatattaacaatatatatatgagatatatatcctgaaaattacaaaatgctgataaaagaaatcaagacctaaataatttcagggatatattgcattcatggattggaagactcagcatagtaaagatgtcaattcttcccaaatcgatctatagatttcatgactgaaaacgattaatgtgggaggaattgctctactcaacatgaagaccttagtatatagctacagtaatgaagacaatgtgatattggtggtgagacagaaacatggagcaatgtaataaaatacagaacccagaaatagaaggaaattattatgccaaactgattctttgcaaaggtgtaaaagcaattcaatgaaggaaactatcattttcaacaaatgatgctagggtatttggatacacataggcagagaaataaacttgacctgaacacctcatactttattcaaacattaactcaaaatagatcatggatactaatataaaacctaacgcttatagatttttcatatatgtatgtgtgtgtgtatgtatacctggattatttccatctatgggtatatatgatttattcctgcctttcctttaaacccaatataattgagaattagtgcaggggtttttcatctttcctagttcaattttacattaataatctttatccctttaaagatattgatattgaattgttggagtttggttttcagaacagatgttttacagtctctggtagctaattgagttttcccattcccttgattacttcttgtactcttagatgaaagttgagtatgtttttcagtgtttattgctaggaaatagttgattacagagtcatttactagataacaaacatggaaagtaatatgacaggtttttgcttttaattgtgcttttaatttttattctacatataggaaagggtagttttcaagaggtatattgcaaaacatttgataaaaatctcttaagaaaactgaatcttgactcaataaaggaacatatgtttccaagcttttttgacaatattaaaaaaaaaactagtcctctggtcaaataaattgaagaagtttctacacaagagtcatgtattttatgtactgttgtaggcatagtaatgatcccccaaagacatacatgttctaatcttaggaagctatgaatatgttgccttatatggcgaaatttaggagtcctcaagtctactctcaggttcaattattccttaggaggactcatataattcttaaaagcagttacactcatgattacagtttattacaacaaaaagataaagactgaagtgaacaaagaaaaaagttgcatacaaccgggttcaggaaagaccaggtgccaccttccagttttcctctcctcatgaagtcatctggacagcatttaattatcccaacagtgatgtgtgacaacacacacatcgtattgccaacgaaaagttgcctaagtcttggtgtctagaattgtattggagtttgtagtaggcatggaacactcacatggctgactttagtcatctccagcctctccagagttcaaactgatacagtgtaacctaaaagctgcaccatacattattaaaataaactatctggtattgcccagaagccagtcaagagccagatatttctttggaatgtacagagtttgaacaacccagtcccgttaagttaatattttaccataaaaaggcaaagtttactttgcagatttgattaaattagggactttgagatggtaagattatcctggattatgtggatggaaccaattaaaaataagcacaaacacacaaagatccttcaaggtggctaggtgcggtggctcatgcctgtaatcccagcactttgggaggctgaggcgggtggatcacctgaggtcaggagttcaagaccagcttggccaacatggtgaaaccccttctctactacaaaatacaaaattagccaggcatggtggtgcatgcctgtaatcccagctacttgggaggctgaggcaggagaattgcttgaacccaggaggcggaagttgtagtgagccaagatcacgccattgcactccagcctgggcaacaagagtgaaactccgtatcaaaaaaaaggaagaaaaaaatccttcaaggagtcaaaggagatgttggaatgaaaagcagtgtgtcagagtaatgtgatgtagactggaagatgctatactgcttgctttgaaaatggaggaaaggggccatgaatcaaggaatgtaggcagcctctagaagctaggaaatggattctcccctagagtctccagaatgaacagcgccccattgacaccttggttttagtccagaactctaagaaagataaaaaaaaaaaaaaaaacaaaaaaaaaacaggctgggcacagtggatcacgcatgtaatcccaacactttgcgaggccaaggtggacggatcacatgaggtcaggagtttgagacctgcctggccaaaatggtaaaagcccatctctactaaaaatacaaaaatttgcttggggtggtgatgcacgcctgtagtcccagcgacttgggaagctgaggcatcagaattgcttgggcctgggagatagaggttgcagtgagccgagatcgtgccaccacactccagcctgggcgacagagtgactgagactctgtctcaaaaaaataaaagataaaaaatatatgtacatttaaatcactaagttcatggtaatttattatatgagcaataggaaactagtagagtttaatataattattatgtctatgtttgtgtagatatatacataaatgggggttgtgtgtgtgtgtgtgtgcgtgtgtaatgtcaaagcaaactttccaaatgcttacttcttgtacatcttaacctcaaggcacacaaacacacactcagttgcataaatgcacattctcacattacacacacacacacacacatatatatgacatactacattctgttctagcttcctttaatgacagctcacaaatatgtgagtagaatacactgggtttgacttgggattatgaaattcatggtaaacatcatcaaggcagatggatatctaggtgtttgattatattgatgaacaggttttggtatacaaagtgacacttgttattaaaattttgatttcatacctatttcaaactaaattgcacctacagtccctttgcaagctccactttttagaaattcagctttgtattcactgcatttatgacattcctttgcattttttttttttttacatccacttcgcttaacaagaagacactgaagttctaagtagcactgtataggactgaattattaatacagttcttcagttggtaacaagaatgctcttggaaatatcttgtacatttgtcttctcctggttacttagtagattgagcatgtaaaaaaatcttttgcttaaaattgcagtacatcttaactgacaatacttcttaaccatagtgcctgacaaaacctggatattataatctcgacgtacaatttggtccagcagttgatctctgctcagatcattcaaaagggcaattagagaaagtcaacaatacacatgtctgtaatttagttttctgtacaaacaccataaccaaatgggatgaaaggatttaaccatttgcaactaaaaacagtatagtgctttataaaaagggcctaatcaagcagtatattgattgaaactttgtacagatggttctcattattcacacattctgtgtttgggagttctcaaaacttgctaaatttaatttgtatccctaaaatcaatgctcatagcattttcacagccatttgtgtgtatgcatagagtggtgaaaaatttaagtcacccaccacacatgttcccagctgagatcaaaaaaggaacactctgcattcttgcttcaggtctcatacggtaaacaagtgtcctttcagcggtgtatttaatgctatgtttttcatatttttatgctttttcttggtgattttgctgctttaaatggccccaagcatgatggtgaatttctgtctagtgttcctaagcttaagaaggctgtgaagtaccttagaaagaaaataggttccttaggtaagtttccttcaggcttgagttacagtgctgttggctgtgtattgaatgttaatggatcaataatatatattcaataagatgtttttaaacagaaaaacaggcaaaatgggattatacattgctggttcacaaaaatgttatgagcagaggctcccagaaatctatcattgtatttctcctgggaggaatgcttcagtattcactaattcagtgttcacagtgactttatagaaacacagtgaataacaagacttgactgcacattgtcatccttcatccaacccacttgcatagtgtagggtctacactttccaacagtactaaaaacccagaacgacattcaagttatgcaggtgtattatttagctgtatttgggttctaagacatgagtaaagttatatatttgtacagctcccaactatatacagttgtccctcagcatgcacgtggtattggttccagtactctcatgtataccaaaatctgaacatactcacatttcacagccaactctgcagaacccgcacacaggcaaaattggccctctatatacgtaggtttcacattctgcgaatactgtatttttgatctgagtctggttgaaaaaaatggcatgtaagtggacccatgcagttcaaacccgtgttttctcaggactcaactatgttatttatccttttacttttttattccttttttattcctgtgtataaaaaattgtaccaccagtacaaggaatgtcatgaaattgaaatgacaccattctgtgtttcttaaataaatgtcatacaggttctatgaagaataaattctcttgctaaaaaaaaaaacttgctatttttcatcatttgattttctcatattaacatttttcatcttaaatagtctttctctttactatttcccttcacatttcttgaaaattctttttcttgcccatctgttttgtatctccttattattttctttctgtttttattatgctagccatggtaatgataaaatctccgacttccaactccctgcaccatttggcacttggcaaatggcttttttatgtatttatatttttgttatttatatgtctatatcctaaacagaaccctacgcataagagcaggtggccagtaactaatggcattgataaaatagagccctttacctctattttcttgaaatatgctttcaagaaattccttgtactagatcatcgtgtatcataacattatgaacacagcagcaaaaaacaagaaaaaaattcagactttagtattcgtaagtaatgtcaatacaatatttggtttaacagacatacgatcattttgtttgctatttcaccatattattttttatgtaaataaggtagattatttccaaagtctttctgaatttactaaaatctcattttacatgaccctactttagtaccttaactaccaccctcctaggaatatatctgtggtaagaacagacaggtgtatatatattatagataagtgtctgtctgtgtgtatgcatacatatgtgtgtatctatatattaaagtatgtatatgcaatatgaaggtatgtatatatgcatatatatgcatgaattatattaagcatatgtatatatatattatagttaagtgtgtgtatgtgtgtatgcatacatatgtgtatctatatattaaagtaggtatatacagtatgaagtatgtatgtatatatgcatatatatgcatgaattatattaagtatatgtatatgtgttagatatttatgtatatatgtatatttataaaattatgaagttctacattgaactgggatataaagtccatgatatctttacataacttagaacagcaaaactctcgattcattcttgttttcaaaatccctttagcttcattttctctggtgcatgaaacaacataaaaatccctcttcttgccattaatctcttcaaatcccatgccagatattgtcaacattacagctataaaaattttagaatgttttagggacatcttgagatctttaaattaaaatatccactaaattaacatcataagcctagactcgtaatctttatttttgatctgactttctgtggcttgcaaatttagaatcaggaaatgaaacaatactcaatttttgcagaattagggcttacttatgatgcaaggctaatatggataatttcttaattgactgtatctgctaagacaaaatcaggaaatgacttaattaaaatgaataatttaggtgatattctctatattgtaatccaaattttaaagaagcgaacttctcttagaagaaaaatatacatttaataattggttcaatgttattatagaccttttgtgttctttcagaacataataatggttgctaattttctgggcagaatctcttgataagagagttaaattgactcagattatctgcaacccactggactattgtggtaatggcagatattttttaaatttaattcattgatataaaatatttagtcttttataataagcaattaaacctttgtacttaagccacttcaacaaaaatattacaaaaccattaggcagctacaataggctccatgcatttttaagtacggtttatacagaataaattatttctgtattggaatatcttcttaataatattgatgtttcaagaaaacatccaagctattttataagttatttgaatggagactgaattatatagtagttttttgttgttgttattttaattcatacaccttttcagtagaaaaaggtgccttggttttaactttgttaccccacaagcacagatattaatttttattgcattcttcactaaagtacatcttgcatttgattttcagacatggataagaccatgatagctaatgaatgactaaaataaatcaatactccaaatacttctatgcttcatttttgatggaagtatgagtaagggatacaagctgaaggcctcctatatatagtacttctacattactttttttgttataattttgtaataataatataatcacaccacatacttgtaataaaaatataatattcatctaggctaattggtcaggtcctgaagtaaatatatctcttcacaaaaggccaatgagtgacccacctactggtagattttatgcaaatggttgcatcttgtacacctttattattttttaagtatatttgtttcctacttgtaacctattctaaaataaaaagtttactatctctttgcagtaaaaataaatatcacatatctatatatataaagatagatatggtatacacctcagtatagatataaagctctttatttatttatttgttcatttatttatttatatttatgtttaaatacagacagatttccagattttaaaatgcatttcttctcactgaatattaagggacttaaaccatatactcaatttgtcaaagctgactggggaatataaagaaagggctagatatgtaatatgtgttgctaatattaactagaatcattattttgaagtacagatcttagttcaataacatagcgcgctagagcagaccaaagttattaacttcaattgataaagaattatgaatataattataatcctgttaattatttaacaccgtgaattatgcaaatgcagcaggtattattaatcatctgcaggaaccagaacaatttccctaaaagaacatataaatattaaaaagtctgacttggctctgttatgtactgttagagctttagtgttcccatatgaacactgtttggattcaattatcctttataacatgaaaaatgccccgaatgcatcctctccaaaggccaaatgaatgtcattagagttctccttttgtctataaaatgtttactgactgtgtggtctcgcatgtttgtttatatcaaaatatctttcatcctattaggctaatactggtctgtggcggctggcatcctacttgctaatagcacgttgtgtggatatccttgctgtgagactaagctacatgtgatagtcttgcagtatctaaaaaaattcccaaaattaacatatgttgaaccttccctcaatactaaggaacaacagagcattcaatggagtaattttaactaatttcctaagtatgctcaccctttacagaaaggaaaaaaagaaaaagaaaaggaattccaaattggacctttggaaaacactcaattggggagaggaattggtaaggggcttgaagatctagtttggttaacagattgttgtaaattttcctgaaggaaatattagccctttcctttaaagagttatttgtggaaacctttaaaaaggattttcaaaataaagactgtttgcctcaatatattggagtttaattcctatccatttttactttatttaaagttagacgattaattgattctcagaaaaattatttgttttaaaaggaagaattatttatttcgaaatctcaaaatatttccaaataccactgtgattcttggaatgcaatctttcttgggaaaatgccaaagttgggcaaagactggggtaggagttaggagagcaggcaaggacatgtaggaaggaaggcaaactagggaactattgtgtttttgaatcttttaaactcttagcctttagaacaatgtctggcatagagacttccaaaaagaatggttcaattcaatgtcataagtagcttgtcatttatggcacattcacaataaatgacagtataaatcaactgcgcattggtagacataccagagtcatgactatttcaacattcattttatccatgtgtttccaagtatgataatagctgaacattacgtggtactcaatgaaatttagatttatgtttatgcctcacatcttagcaattatatttgaaaaactggtgtctgtacagaatgttacagtttaaaaaggattttggatgagtaacttttgaaggaggtaggatttggggactctaaaatatttttcttcttatttttattgaatttctgcctgtgactgctttctaccctaacaatagaggcgctgcttactgtgctgcctgctgtatctcactggaaccattagtacttacaatgggcctttctgatctttatttctatatatttatattttttctgagatggagtctcgctctgtcacccaggccggagtgcagtggcgcatggctcactgtaacttctgcctcccgggttcaagtgattctcctgcctcagcctcccaagtagctgggactacaggcgtatgccacgacacccagctaattttttgtatttttagtagagacggggtttcactgtgttagccaggatggtctcgaactcctgacctcaggtgatccgcccgccttggcctcccaaagttctgggattacaggcgtgagccaccgtgcccagcctctgatcttttactctttctaaggatgactcgtgagtgaaatgtcaaactcttttatttatttatttatttttacaaaattaaaaaagatataatctgggaaaaatataacatctgaatttttattatatgtaagtctattaggtggaaggtagaaatagggccagccagtagaaattgaattctttgcatgaaggagagcaaatttaggtgtaatataagaaagaactttctaatagctaaatctgtctcgagttgcaatgatcatgcattcttctctcctcttttatttttggccactgctggatttcagggatcatcatctggactctctctgctccaatacatacttggaatctatttaatcaatgttgttattaaaaggatataattttacatactttaaaagaattttgtccaatactcctcaaaacaatccaatgagctaaatattaatatcctcattttgcagataagtaaactgaggcatagagcatgtattagtcagggtggggataaacaacttgtccaaagtcaccaactatttgagagcacattgaaacttaggcagggtagcgccatagtatcttgttgtaatatctactctatgctgcatctgtcctcagtattacagagacagagtctgggtccccatggctttgtactaattgagactttggattgtttgccccaattttcttctccagactcactttccaacatgacatttatattgctgtgatgtagccacatagaatctctcacctctcacccaaacatgccaggagttttcaagcctctgtgccatttgcctttcccctccatgtcccccacacccatcacagccctacttctaccattctatcagtggaaatctcctacttatttcctcaattaaatgttgttccctctatacatttagcaaataccaggcccatttaggtactccttcctcattttagccaaagcttcagattttcagctctactatgaccatacgttatattaaatcatgtatatttctgttccttgttataaactggaaactgcaagatcaggaaccacatcttcttcatttgtgtacctttagacttcaataagtaaatgcattaaaaatttgtctaaatgaatgatgcacatgtaacataaagcaagagtttcttttcatagtaagtattcaagcaggagctaaattgaccagccagcatcactgtggtaaagaagacaactgcatagggagaaaggttaagctggatacttgtctctatggcctttttgtagctctctcattgcaatttcatgtcatgccttacagctaaaaagtgccagtcagaaatacctatccattgtgtgtggctcaggctagttgattatgatccccaaggcctagttcttagaaaatgtgtttgtattatagtccaaaaggagctactctctgtctcctttcctcactaaattctcttttatatttttcaagtttacagaagctatatttgggcacagacttcagtaatttttcctctgtgcataaacactcaaccaggaaatatttatccctcagagacactgacaaaagatgtgttcttaagttattgctaagaactaatccttttcaccatgggaggaaaacgtaatgctctataatgtgacttatgagactgaaggttttttataacatagaatgaaatgataagagaatactcttgaatatatgtttgtagttaattacagaagtgtgcaaacaaacttctgacattagtttgttttgtctcctaaattaggtatagatttcttttttttttttttgaagttatatttggcattttttttaaattttattattattatactctaagttttagggtacatgtgcacaatgtgcaggttagttacgtatgtatacatgtgccatgctggtgtgctgcacccattaactcgtcatttagcattaggtatatctcctaatgctatccctcccccctccccccaccccacaacagtccccggagtgtgatgttccccttcctgcgtccatgtgttctcattgttcagttcccacctatgagtgagaacatgcggtgtttggttttttgtccttgcaatggtttgctgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaatgaacatacgtgtgcatgtgtctttatagcagcatgatttatagtcctttgggtatatacccagtaatgggatggctgtgtcaaatggtatttctagttctagatccctgaggaatcgccacactgacttccacaatggttgaactagtttacagtcccgccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttgatgagatcccatttgtcaattttggcttttgttgccattgcttttggtgttttagacatgaagtccttgcctatgcctatgtcctgaatggtaatgcctaggttttcttctagggtttttatggttttaggtctaacgtttaagtctttaatccatcttgaattaatttttgtataaggtgtgaggaagggatccagtttcagctttctccatatggctagccagttttcccagcaccatttattaaatagggaatcctttccccattgcttgtttttctcaggtttgtcaaagatcagatagttgtagatatgcagcattatttctgagggctctgttctgttccattgatctgtatctctgttttggtaccagtaccatgctgttttggttactgtagccttgtagtatagtttagatttctaattgttggagagagaatctgtttacatattggtgaccgttacaagcaaatctaaaatataacatcattttacatcatatattaaattatattaaaattcattaataaatttgaaaggaattaattcatatttataataaataacttcagaagattcactgatttaatggaaaaatttgttgataaaattatattaagagaggaaacaaaagacattaaataaatttgaaatgataaatattcagacatttaaaaaattaagtgtattagttcattctcacactgctataaagaaatacccaataatgcataattcataaaggaaagaggtttaattgactcacagttcagcctggctggggaggcctcaggaaacttacaatcatggcagaaggggaagcaaacacatcctcatcacatggcggcagcaaggagaagaatgagagccaagcaaagggggaagtcccttataaaaccatcagatctcatgagaacttacttgctatcacaagaatagcatggggaaaccacccccatgattcagttatctcccactgggtctctcccaccacacagggggattatgggaactacaagatgaaatttgggtggggacacagacaaaccatatcagtaagtatctacataatccatttgtaattcttcccatcccatattcctattacccaggatttgtgtaatctaggagacataaaacttctgaatttgtattatatgtaagtctcttcggtggaaagaagaatgttggctttattttatcattttaatcttagaagattttaaaaccataattcttaactgaaactaagcttattttggcttgttatatataccacataacttaaaattttaaaatgtaaaataccaaaggagttgaaaattatgtccacacaaaaccctgcacatggatgtttatgacagctttattcatcattgccaaaatttggaagcaaccaagatgtccttcagtaggtgaatggataaataagatgtagaacattcagacaataagatgttattcattgctaaaaagaaatgagctactgagccatgaaaaacacatagaggaaaccagtgaacaagcaaatctgaaaaaatctacatactatatgatttcaacaatacgacattctgggaaagcaaaaactatgtagacagttaaaagatcagtgttttccaggggctgtgagggaaatgtatgaatacgtagagtccagaggaattttaggacagggaaattctctgtaatgatgctataattgtgaatacatttcattatatatttgtccaaatccatagaatgcacaacacccaagaatgaacctttactcttaactatggaattttggtgataatgatttgtcaatataggttcatcaattgtaacaaatgtacccgtctggtgggagatgtagatagcgtgggtggctgtacgtgtgtggaggcaggggatatatgagaaatctctgtaccttcctctcaattttgctgtgacgctaatactactctagaaaaattaagttctttaaaaaatgtgcaacactactaataccactatagaaaaatggaaagagtaaagagaacaaatagcttaccgcaaaagaaatataaatgcccaagaaatatgaagatatgctcacggaattagtagaataactaaatcagtagtttttaattttaaatttatttttatgtaaattttacctatcaacctagaaatggtgaatacagtagaagagtcagtgaagtgggcatgccctttcttgttggtgaggttataaatcagtctaatggtttttgaaagcattttggcaatatgcataaagagtgtatttgaccctatgacccagcaatttgtcttctgagactcttccctaaagacatgattaaatagtatggacaaggttattctttgctatgttacttttaagaaaagtggaaatgaccagcaacctaagtagctgaaaaataagggtcagataaacaaatcttggcatatctgttgcaacggaacattaagcacttattaaaattatgttttcaagaatatttagtaagatgaataaaaattgatcacattataaaaatatatagccaatatgtttaatactatgaaatatgtgtgtagaaaaatgaatattaaaataaaatttttcaaaatattaaaacttaatatcttacatgatgaaatgtgtcatgtatgtattttatcttacaaactgctatgatctgaatgtgtcctacataattcatatgttgaaacttaattgccaatatgatagtactaaaaggtggaggacattaggaggtgattaaatcatgagggcagagccctaatgaatgggattaatgaccttataaaaaggctggtgagaaccgagaactaactaggctcttatatttttccatcacttccactatgggaggacacagcatcccttctctctggaggatgcaacgttcaaggcatcatcttcgaagcagagactgggtcctcaccagacacctcaccagcctacagaactgcgaacaattaatttctgttgtttataaattacctgtctcagatattttgttataatggcgccagtggactaagacacaaatattttcttacaacaaagggaaaaaacttactgcataattttgtaaaatcgaattggaatgagatacactgtgttcacaattttaaaaagtttcacaagggcataagatcattatgcttggcatgtcttccttaaaaaaaaatataccatgaagtataatttctaagcattatgtagagagccacctatttctgtctgtttggagtgggcagggtatccacacactattttgaagaggtgcttgcaaaattgagatggaaaaatgtgtacgtacagttcctaaggccttacctggagagtgaattgccctggtttttacaggtaataccacttggaaggaaactcatgcttctccctaaatcagacaatgcctggccttgagtggtgtcagggtcctggtgataatggttattttaacctcctgcttttctacttctagcatattctgcctttggcttcatgcaaaatactgaaggacagcgagtgcatggatactgctttatcgaaccttgttaattggtctctttgctataagaaatacattgtccctgaagccacaatactaacgcgactggttctacatcttaaaaaatctttgatattttacactgtgtctgttacatggctattatgtttaaactcccttgattagattatagaagtttacattggggaagagtatgtaaaagagacagcaattactgccaaaatcttccccaaatcagtgtcttagtccttttagactggtgtaacaaaaataccataaacagggtggcttataaagaacagaaatttatttctcccagttatggaggcggggaagttcaaggtcaaggtgcaggcacgctcactgagcttccaaggcctcttgggcctctcttataagggcattaatcccattcatgaaggtagagccctcatgacccaataaattcccaaaggcactaccttataatatagtcatcttggtgattagaattcaacatatgaagtttgagaagacacaaacaatcacagtatggcatccaaacattacaaagagttatagtttgtctccacagttagcttagtattaaattttcctcatcagcaagataggaaaaggttagttgaggatgaaccagaagttttcacctgatcatattgacatgggtgcctgataatctcatgcctttatgggaattatatgttcttcattaaaaacaaagaattctggcctttgccaatgatggctttaaactagtacaagcattctgggtgtggctgtggtatttgatcaaagctaatatttgctaatttgcatgttcaatgcaacaatcataaaatactggatagtttcaggtctagtttatgcaccacaaaaaagcaatgataaaactcattcatcttcactttaaagtcgttgtgaagtggctgtttccactgggaatatataggtagcatgtaaaacagttgtcttttctggtaaaggggtttcttgctaaggcgtgaccacaaccaagtgattctttctcttttgattagtattcattgtctcttctgagctgtctctagtggatacagtttagaaatttaacataaagaaagaaagagctctcacactgtaggatttgcagcatgctatttaagtgcaactgctaccacagttaaaggatcatcggaaacatcaaggtgaatgggaaagtggagagagtcaaaattcaagaagagacttttatattattaaaatttattcaaactgtaattgtaaaaatggcatggaggaaaagttaaagtcgaaaatatcagcagtatgtaaaaaaggacaatgtaaaacatctaccaattgtcagaatggctagaaaaacatattccattattcagccaaatattcttgcctttacctctccctgttctttacctgtccacccctagactgtatctttcttgcatatttcattttaagattcttgcacataatttagagaactgaagcaactacctagcccatctttcctcactaggccttccttagaatctgcacggagtcaagtttatggcccctttgaaaagctgcagctccttaccaaagttttttcaaatagaagctaagaagggaaggagtaaaagacagcatttgtataaacattagctcatgtaatcactataaccacctatttaaggtagatgatattaatttcattttcctgaggaaacttactgccattcagatcaaaagtcttctgcaaagtcctacaagtaccaaaagaaaaagtcagggtttttacctatatctctctaactctgattatgtcatttttcttttctctcattttggttttcaactatagagtaacataataaccacttactctcaggaaaaaaaaattagaataaaaatttgcagaccttgcttataaagatttaattacatttaaaataaatagagaaaatatttggaaagtttatttttaataatgatgagtttcatttaagttatgtattctctgtacctattatgaaatatattctgtgaagttgtggttatctgatacaggtggaggtggtagacattaagactcttgatagctgttccgcttctgtcccctttctggtacgtggaatcacttccgcactcacttgaagttgagtctggctgtgtgacatgccggatcaatgaaatgtgcgaagaagtgaactgtgtcacttttggacagatgttctaagagccattgaatgttttactgtgttctgttttctctcagacctatcaaccaacaacactcaaaagttggctgctttatcttcctgagaccaacaacactcaaaatgttggctgttttatcttcctgagtgattacagtatgtagccatcccctgcttattaggataggcacagagtatcagcaagaaataagatactaagagaatagaatttgttattactaaagattttcctaaagtgtccgatacgctcaacattgacgattgttttgcagccaaaacagcaaacatatttaagaaatgtgtttaagaatcacatattgaatctgtgattcacatttgttgtgatggtaaaatatttgtgtagttttctccttttttcagcttctattttaaataacataaattgtttgaaattttgttaatggttcttgaaattaaagacgttcagcaatgatatggtcttaatagaaggaaattgttttccatcactgaagattaattaaattttgagtaagaattgagatatgtgcggctaacacagggaattatctctgtgtttctggatgaaatgggattattaaaacatgaaggaactattttcctcttacggtaagagaacagtaacttaatagtgaaaatcagttgatcatcacatgcttgtggctaaatatcagtttgtcctttttgtagctgctgtaatgatatgttattgaaatcatttagggatacttttttgttgttaatttttatggaggtattattgagaaataaaaacattctatatatttaagatatacaacacggtattttgatataattaacatatccatcaccgggcatagtagtctcttttttttgtgatgagaacacttatgatctactccctcagcaagtttcaagtataaaggacattaatattaactacagttaccatgctgtacgttagatctctataactgaaggttcctactctctgaccaacaactccccatttataccactcctggcaaccgctattctactccctacttctataagttcaacattttatattccacacataatatcatgcaacatttgtctttcatttttttctgcccttatttcacatagcatatgtcctccaagttcaccttgttgcaaatcgcaagatttccttctttttatggctgaataatatttcattgtatacataccataatttctttattcatccatacatccacaaacacaggttgtggctatatcttggctattgtgaataatgcagcaataaatgtcagagtacagatatatttttgagatactaatttcatgttcttcaggtaaataatcaacagtgaaattgctagatctcatggtaattctatttttaatagtttgagaaacctccctactattttttttgtaatggctgtaccaatttacattcccacaaacagtgcatgagggtttccttttctccaaatcctcaccaacacgtatttttaaagatacaatgagacaaactttttatttaaaattatagaacaagaatgaatattaccaattcatcaaaaaaaaagtctgtctactatcaaagtctatttttaaactttatgttcttttacttaaatatttttggaaaaaaagataattatgtacactaatgtgtgtgtgtacattcacaatttggcatatactattaatttggtttaaatttaatttggacataataattcttaaaacttgtcagactgcttgataagtaggtattagtgtatcccacctcatctacagagatgaaaactacagcgtaagttatctaaaacagtaagtgtattggatctcaggaagtatcacttcagaggtgttattcttaacaataacactattcagcaaatgctgcaagaataaaatcattaaaataattttctaaacatcaaataagccaaagtgaatgtaagcttttgtgaataagtttagattcagttaaatttctcaaggatcagctaaattttttaatcaaaaatttcaaccaggtactaaaactattttttgtgtcttcctttgacatatgggctatgtatatgttatataaaaccaaataatgggatatttctgattattatacatttgaaacatatcattgtgtctagcttcataacgtagctatcatattttggtaagttaaattgtatgtcaaatgggtgctcagtctggaagactcaaaaactagaatttttcttttttctaaaatttagtaataattgacaaataaaagcatctggtaccattatacttcctacagtctatattctcctatcatgataaaactggaattcatattatattgaaaaacctcttatttttttcttttttcttctttaactacatcctacagtgtaccctagaagacataaattcaaaaatgtgaatagttctgagaggttttcttgggattttaccttttatgaaactgctataatttatagaatctgcttgtgctctgtcacctaaatttaaaaagctgccttttattatttattttttagtttgctccattcagacagtgatgtttcatgtgggagacatcaccacaatggattactttaacttggaataaccttgctttaataattatatggaatacctttcacaagagaaagcattactaggagaaaagccaataaagctatgaaagacatggataaaagtcaacagctgattggatatagaatctaaataatgtgatatgatttaacttacctggatctcataggtaaaatgaagaaatgatagttacatatcagaattcatatagaatatatgtgagataatgcaaataaatattttagtatcatatttgtcacaaaatagtttgtcatcacatattagctcatcccccatggatgtctcttgtcatacggttgatagaattctgtgtccatttgtgtaattttagctccctaaggatagccactatttgtcactcactgttttatctagatagcacagaaactgatagggagtagtcaataactcagtaaatgtttggccagtgaatggatttacaacatccctgtggaaataatggtagatgtgggtctgtttattgcacaccgcaattgtcaggatgtttattgcataaccagttgtcactggttagtctctgtgtttgtttctgaatttgtttagaacaaggctttatttttactaaaaatataacttgagttgctgacgaattttcagtttttactcatttaccttgctgatatagctagctgaatttacatatctatgtcactatttgtatttatctttatctccatatatttatattatatatacttatgtctgtatctctctatatatgtctctttggggatgtgtactgtgtaggtatattttaaccaccagctcagtgagaaagaactcaagctatgattcttagtgtttgcttatttctgtggtgtaaatacttcaaccacatccagtttcaagctatcaacatgatgttgctgagtgtggagctgggatgagataggtagtggccaattattatatagcattttcaccatacagataaaaggatacaaataacctcacaagtgtagacgacagtgaaatgtagtaaaataattaagaagtgatgagttttgaacatttattacagttgctttaatataatttatttaatcataagtttatttaattttaacaagggctatgtttaatagtatgccctcaaaattccttaagatttagcattcagctttcacaatccatagtaaatctttaatttcaaagtctctgttgcttttcattgtaaaactaaacgtaatccatgctttaactcttttctggttgttttcatatgtcctttaaattctcgatgttttgtatgtttctacagtgaatatttgtgagttgaaactttttaaataattcaagaatatacttttgtgtgtgactttgaaattgtatatactgcttgtatgatttctataatctattgccaagggtaataagagctagtcttaaaatcaaaaaggcactatattactctttgattcccttttttttttctcttaatgaagctgaaataactgggcactgaagataaaatatatgttaactagaagagtatttgctataaaataaaaaatttgacacattttggcaaaagttttttttttcggtagtaaacattttactacctagtatcaaatatattaaacttaataaatataagaaaacagagcctacaaatgcaaagtctaaatcctaatttttacctgcaattgttacttatatgagttcatttttctaaattaaaactaaatcaatctactctacctcctattcatggcctctgccactgcagtcctgaaggttggggtgaagatactcacattttacaagtttgtgaaatattaactaaaaaactatggcgaaatataaacatgaacattttggagagaaacacttctgaaatggtagtgtgtagtgtcaggggctccatggatgctgtcccgagtaaaacaactgtaactggtgaaaattgtaataaaataaccatggaaagtctctggaaatggtcttaagagcatatagcaaatggagaaatatttattcaaaacaaaaaaacctgcaaaatctcagtcagaacagtgaaagttaatgacatttgagcaacaatccccaccccaaccccactctctctagctctgtgtgacagaaactttactctggatagacatggccaaaaacagggtgcttcttctacgtgattctcttcttctttttacttatcagcagaagctgctgtggcttatcaccacgtctggtcatagctgaagagatgtggctgcttctgtatctcctgagctaccacacctagcgcagatccttcctctcataaatgagggagaggctaagaccatgaaaatgagaaagaatcatcttttaaacaaacggtgctgagaaaacttgagattcacatgcagaagaatgaagttgaccctttacctcttggtgaggaagaatataaaacgtttgggcagttatctaccttttggacacatacttaatattagctacactatgaattattggtttggggtgagttagtgagaaacgggttccttttatatgtttagcctagaggcaggtatcgagagagggcttaaatgaacatcctacaataaagtttaaatttttcatcctccattgcagctaggtatgatcatgtgacctggttctgataggacataataagaattaatgtgtgaaacttctaggaagagaagtccatcttcccctatcttccttgttatttctcactgttacttggatggcaatgtgatgattggagcttgaatagccatctggactacaaaatggaagttgtatgttgaagaagacaaactaataatataaattgtccaatgtccctgatgatcatggagccactgtactgcctctcaactgtctcttcttatttcagaaagatgcaaacttccattgttcctgatattggttattttggattttctgtcacttgtagctcagttctaatctcaatgaatgcaagagtcactgacaacctgctatagccaaggtactatattaggcactgacaggtctagggtgaaaaagagacatcgcctggttttcacagagcatacttactagtgagaaaagataaaaatcaaatatttaaagaatatgattttgagggataatcacataacctatagtgagtgaatctggatttaagggcttctcaattcaaagaaaagggaaggccactatgaagcagtgatagctgagctgatacatgagataatagacagacctatacatgtgatgatctggataacagaattctatatagggaaacaggaagcacaaagggaggaatggactaaaaaaagagaagcagaaaaattgacttgtgtggttggagtagagagggcaatggtaagagcaacaatgggagatgaggttagaaaatagagtaggagtcaaatgaaacagggtttaataggtgagggataaaagcaaaaccaaaaatatatacttcagaatcttgtcctggcatctgtttttcctccaatcatctcctcctttgtatattttctttcttttttttcttcatctatatatcttctcatttcattcattcaatcacctatacaatgtggtccactgtctccagaatccaaaatccaggattgtatcctactatttttttgtagattttctacattcaattgtacataaaaaactggcctaggaaatccgcaccccatcgtaatttgtattacaaatttaaaaccagtagctctcaaatcaaatttggataagaatcaatgtactactttgaagatcttccgaatatgtatatctgtttataaataacatatattttaaagtgttaacttatgatctttcattgatacatttctgttttataaaacatgatattcatgatagatctattttattcatttcaacatagatattatcttcgctactcttttaaaatagttttgaggttccaacacccagaaagtgttgaggaaaatttgtatcttctaatggtactaaatataatgtaactgactttgagctgtataaaaaaatgattccaaaatgagtcctaactcttggttttaaaggtgatgtaggtgtgaagggagatgtgacaaaaccccaaagattgttacggaagttttggggaagggaatgaaaacaaacccaccgtggtaattactcctaagattgatgaaaatagaaagtcttgtgcagtattagtagtggaatacatacattcttataaatttgcttgagataatgtggacaatgtgtattaaatgttaaaattggcatatataatttgcatgaatatacaaatgggttacatcttattccctaatacaagtgtggtcaaataaattatataagatttataaaatagcaaattatgcagccatcaaattattgaattgtttcagtatataaaagtagaaacatggccagaaactattgaaaaatattacaagtgagttacaaaacaatatatgtagtaggatttttagggtaacatatatcgaagcagaatgtgggaaagatgaagacggagacacagaaaaaactgtcgtttggaaatagtcttcaaataaattgggtgtctatctcttggcaataaaattataagtatttctctttttatttatatgtagctttttccagtgaaataataattattataataaaaagactttttaattcaagacaaaataacgagaacatcagtgtgattagaaggcattacatggggataaatggcagccatgtcatctgcaaacagagacaatttgacttcctatttgaataccctttatttctttctcttgcctgattgccctggccagaacttccaatactatgttgaataggagtggtgagcgagggcatccttgtcttgtgcgggttttcaaagtgaatgcttccagcttttgcccattcactatgatattgtctgtgggtttgtcataaatagctcttattgttttaagatatactccaacaatacctagtttattaagagtttttagcatgaaggggtgttgaattttatcgaaggccttttctgcatctattgagataatcgtagtttttgtcattggtgctgtttatgtgctggattatgtttattgatttgcatgtgttgaaccagccttgcttcccagggatgaagtcgacttaatcgtggtgggtaagctttttgatgtgctgctggattcagtttgccagtattttattgaggatttttgcattgatgttcatcagggatattggcctgaaattttctttttttgttgtgtctcataattggtgggaaatacatatatgttgagaatatatccgttgtttgaaaaacatgacttttatattcaaaagttgtaatctttttatgaagatgcattttcttttttaaggatgaaggaggggtagatgtatttttaagctaggaggaaagaaattcgactttctggcagcttattttgtgaccatgtataaatcaagcaaacaaaagctttcacttatagtaaagttcacttgaagataaaaattgaccaggaattaaagacattgtatgcacttgtctagtttatattacttgagggtggtggtaagatgttttctggcttgtatagcatgcatgtattaaagacctgagacataaagaagcaagtatatttgaggaactaaagtcaagcacagctagaatgaggaaagatgaatgaatcaacatgggttgggggagatatgtaaacagggattacctcatgcagcatcctatagttcgtgtttagcattctggattttataaccaaaaaaataaggagccgcttatgagatttagtcaaacggaataacatcatcatctttatctttttaaagctcattgtgagttcatgtggcagagagactttattgggaatagaggtacttatatagggattggaggatcaacaggctgaggaaagatgaaagaccagtaggaggtcgtagtacttataaagtcataagtgtaatatgattttgattagaatagtaacaatagacactgtttaaaaacactttttagtggtagaatctacgtgtcttgaagcttgattaaatgaaggtgaggaagacagaaatcttaaatgatacaaagttctgacaagagaagtttaataaatagtagttccatttaccaaggtgagaaatatataaggaggagcacatttggggtggaattcgttttgttttcttttgttttttattcatgtcatgttatgtttgaagtggacttgttcagtaagcagcagaaaatatgtgcctggaatatatgcgctcatttaaaagttatttccttttaaataattgctcattctgcagaaaatggctgactttgaatatcagctgttttctttttctttttcaggaaatcattcttgaaatggtaaacatccaagttttatcaaataccaggatataattgcctggtgtgaattattattttgttagtaactataatagataatccacagaaaatcttttggaaataaaagacttgaaattaaaagctatctggaatgttatatttaaggacacagaccttgaatgactgttcttcaagtaaagagtctttgttgacagatatcaaaatgtcttatattatgaattcacctcaacttagaattatgttaaaatgtgtggccttccttgaaacaccacctaaaagaattttcttattgtcaaacaaacacttaaaaaatagtttttgaaaaatgagtaaattggtattgataatcttatagaacatgtgtacagtttttaaaatatattgaatgtaaatagtgtctttctgtgtgaaactaaacaaatattggacacctccaaaaatattttgttctgaaattttccttggattgaaaaaatgactcaaatcccatattctacttacatctttattgtagcatgacttagggctcttctgtgaatgagcgtttacaccttattttaaaaaattatgttttaaaacaatttcctttgaaaataatggttttcaaaggaaaaaaagagcatctagggctcagaaaattttctttatacttgcaattcaaagttattttcctgcagcaatttcttaaatgaagatttttttaattaaaaaaactatattttgttgttgcaagatagaaataataactttgttgttcaaaattgacagagacgagcctaatgacttccttgtctgaccttgtctataaacttggaaacctcacagtctcgtcttcctgttgtcttcggatgtaattttgttggtagctcaggtcatatttgcttgtgtctatagtaactgagcccttttcgactttaggcactgtgcaagttagttggcatatgccacaagaataaaaaataaaaccaacagctattgtctcttggttacaatccttaatgttctaatgacctttctggaaaggtgatatttacgctgagatcctctgaactataaaaattggagggagagagaaggggaagacattcagtacagagaaataacatgtacaatggctcttaagcttcgaagaattagcgaacttagggaaatgatagaggccagcatctgtggagccatgaaatgaggcaggaaagtttgacgggacacctgtgaatctagagtgttttaacttcatcctaaggtcaataggaggccattgaacaatttgaggggatgtcacaatgggatgtacacttgggcattactctgatgctgtttgcagtgagaagaatatagagagggcaagatctcaggagatacagagttttatgttgggtacaggttggccgaagtaaattgtgtttatctatacaataaggttagatgaagtttgcaattgatttagttaaaaaatttcaaaaactggatgaccacataaataggaacagataacctattcggaaatatggcttccccggtccatcagatttcccagtggaatggcacccatgacactaaaggcccaatgtgagatctgcctagttatagaaagtaaaatctttatttttaccttaccctgttcaactgggatattacatcaccacttcgaaagaatttgaactaatcatctatgtgcttccattcaagagaatatttatataaatatctggttttttataatccttaaactaaacctagaataaaaaggccacatcatcatcagtggctcagccagctttccagaaggctggaaagccattcacctcgaggaggctctttcacttttgcggggtggctttgacaagggtagtggcacttatgaaggaaagaaagtagcctcacatgaagtattatttgcagggagcactgacaggctttgcagatgagttgaatggtaggaattgttttggagaaggtaagaatcataaaggattgcctgatgatggattgtggtgtgagtgagctaatattcctaactcagaagcatccattacttaaattaacaactaaggtgtgattgtgtcccagtttagagttcagcttctatttttgcactggcctagtgctctacattctactcctgtctttttaaccgttccttacttttcagatctatataattttatgctttactttttattgatgttgaagaaaaggcatttcttcttcttaagcagctagtatgggtatcataattcagctcaaaatcagttacaaggattttcattgttcaatagtgtaaaaatataataaatatccttgatgcctgtggtgaaatactatcaagcagctaaaaagagtgtattagataagtggttctcaaccaggcatgagtttggccatgaataagacatttgacaatgtctgcagttttttttatcgtaattactgcggaagtggtagcattgtactggcatctagtaggtagaagacagagattctggcaaacatcctacaatgcaaaggacggcctcccccgaacaaacaattatcagtccaaaacgttaaaagtgccacttttgaaaaaccctgtattaattagatccatatctcacaataattatgtaacccaaatatataatattgagtgaaaaaggaaagttgtagaacgattgcaaagcgtgatagtatattcattcttttaatgctagctagcatagcaaaccaaacccacaatttcagtgccttaacacaacagatatttattgtttgctcatgtcacagtccatggcattccatggcagcgtgttgctttcctgcatgtgacgatgcaaggatccagacgtcttccattttgttgctcccccgcatctcttcaacctcagagtcatctgcatacatccatagaatgggaaagaaacagcagagaagatatattagctttttaaaatctgaagctctgaattgacacaaattacttccactcatattctactgggagaaacaaatcaaataaccacacctgcatgcaagaagagctatataatacaattagaggctgaacagcctgtcagcgatactacctgggtatggagtggatcaacatggattcttatggatagctcattagctcaatgaaggatgccaagcactcaagtaaatttgtaaagaacatacacacatacatacacaacaacaacattatgtattgtttatggatataggaatgtatgtgaaaagcagaacaattgagctaaattaatgaacataaaattcatatatcatggcctcttataaagacgagagcaggagaacaggcctggagataaggaagtaaagtgttttcacatgtatttgaatcattttcttttataattagattatgcacaataaattaggacagattattcataattatgatttcctggagatatgtactcattgtataagtctctggacttctctaattttacctttctcaaaagaaaataaataagttgagtaagttggatgtatttgtatcagccaattaacttttatattgatatttaaatgagatataacatctacattattttttacatttatgtaaaattctagatatataaaacaagaatttttataaaagctattgttgttattaaggtatactttggtggaacattgtacagtgttctttatcgtatggtcctattcagattatgtaccaaatgcaatactaatatgctctcaagcttcttgaaaaaaatcctatctacatcacgataatatgttggtaatatttttgttccctgtttattttggtatctcaagtagtctcatcttttcttttagaatatacctgatttttaagtcatcttgtaaatatcaataatgtctttctttcttgcaagaaacagaaacccaaacaaaatacaattcaaaattcaaggtgtatttgtgcatactctggattatctactggtagaacccaagaaaaatttaacctacaggccatgggaatgatggggccataggccatctccatagtggtatgctactaagaatgactcattgcacaaattctcattttatgagtctcaggtaaagtattttaggaagtgcatctgtttgttccaagttgaatcaggcctcaatcttggtccagtcagccttgtcctagaggcaaatatcacacaatacaaacatgatatcaaggactctgcttatggattgtttgactggagggtgatagtcgccagagaagggagaaaaattatggactgagtagaacttcccaaatatctcttgtttagtgtgtttcttgttccacattattttgacagaaagaattctgagttatattatttgatcctccaagtttcaaaatccttacaaacaaaaatgtttttaatgccttcacatgtatgtttctttctatcatgttactttgaattatgaatgcatcaatatgtaatgttacagcattaaatgtatcaagtttgcttctccactacattataacacacacacacacacacacaaatgaattcgtattaaactttttgaaatctatgatttaaatagagagataagaagaataatgactggttcattatattacacaacctatgctttgtatatggttttcttttttaaaaatgtactttgtaagttgagaaaaaaggtaattgacaaaataccagtgtaaattttgaacacaataaaataaaattacatcagcccaattacaaagcaacatgtatgaatagcttaaccaactctcctgttttaggtccttacgtgaaccaaaatcctgttgttatttatcacttattggaaccaaaaagagccacagatgttgctttgaagagcaggatgctatgaagtactgttttaaagaccttattaaacacttcactgaaataggaagtcatttatgtagtcattaatacccctcactgcatttaaaccacagttctcaaaggaaaaagctgctcctctctcacagttttgttgttacttacttttaaaaatcaaagatcaatacctttaatgagaacatattgggaatatctatgtgctacgctctaaattaagcattagggcaaaaaaaaaaagatgatttttaaagtcttttcttttgaattttgaattgagatagaaaaccaacgttataggcccataaaagggcctgtaactggagacaagaagggggaaaggctgaaaaatatacctataccaaatttgaagagagcattgatagtcagtaaatatattgcagcaacattatgaaggtttgtgtaagccatgataaaaagcatagaataaaatatttaacataaaaagtagaagaggctcagcaaaaatttccttctattcacctgtcttaaaaagttaagtatttttatcttgtgtttaatgaagaagaatttggaaactaaaagttccaaaaattaataaatttttggctatgcactgttatgtccttttgttaaaaaacactaattgttgagaaaaacctgattgctctatcatctttttatattcaaaccaaatgtgcttgattaaatgttttagatgtcttattaatagacagtcttgatcttggctaaaacatctatagaaaggcttacgcagtgtgctaggtgcatgttgaactccctgtgttgttcaaactagagacataaatgattaatgaatactttatcatatgttatatgtgtattttatatatatatataaaattatagtcatgtactcatctgtaatttcaagttggtagacatttttgtttgcataattttgacagatttgttttgttttgtcttgttttttgagacagtctttctctgtcgcccaggctggagtgcagtggcgcgatcttggctcactgcaacctccgcctcccgggttcacgccattctcctgcctcagcctcctgagtagctgggactacaggcgcccgccaccatgcccagctaattttttgtatttttagtagagatgaggtttcaccatgttagccaggatggtctcaatctcctgaccttgtgatccacccgcctcggcctcccaaagtactgggattacaggtgtgagccaccgcacctggcctcgacagatgttttcataaaattaaataataaaatacaatctacatattaaagttttatatatttctgtaaattgagatatttttattgtcggcactatttttagttaggttgcttaaataaatactaaatatacaatgaaaacgaacatacctagtacagtcattctactcatcacttggtatagttgatgtttttttttttttttctttgagaccaaattttgctctttgtcacccaggctggagtacaatggtgcgatctcagctcactgcaacctccacctcctgggttcaagcaattctcctgcctcagcctcccgagtgcccaccaccacgctcggctaattttttgtatttttagtagagacggggtttcaccatgttggtcaggctggtctcaaactcctgacctcaggtgatccacccacgttggcctcccaaagtgctgggattacaggcgtgagccaccgcatttgaccaagttgatgttttatttgttattaatttcaaaggctgacatgtacttatgatttcagtagttaccagctactctacacgcagcatggtacaattaaatgtatatttagcttttggaacatttctttttaaaagttgtgcacattttaaaaaccaagttatctgaatcacgtgttaaaacatattaaaacaagactgagaattccatttcggacaagatggcataaactgatttttccctgctcctcatagtgaagaagaacaataaaacctagaaacaaaacaagaggccatcaaaagaaaattgtaaaggatagtcagagaaaagcaaactgctttgagagcctcgcgctagaggaaaataaactgcagcacattctcatatgtgcccctatccaacagaagatggggacccccacctgtcattttccaactttcaagcctagtagcagaaggcagcccagctagtttcctctctgaattgaataggagtctctcagacaataccagatgagcctggtataactggcaagggctattgaatgggagcccatctaacattaagcagctagggtaagtgcctctcctttcccagggatttaggactaccatgctctgctgaaaaatagacaagtggcagtattgtttagaggaattttgtcacagcaagtggcccaacctcggaagcctctttgtccctacaggcctaagacactctcactcactctcactcacaacaggaaatacttaggtggctgggtgcaactgccacaagggattttaccactctaagtggcctagtgcaggaagcctctttgttcctgtgggtctgaggctgccctctattgtacagagatactggggcagccacagggtactagaagagggatccctcaagaacaaaatcccatccagaaagcactgtctgttcccaataggcacagagatcttgccacaagtgtcctaactactgaagcctcttcatacctgcagaactgaggctctcttttccgacaggaagacatcgaggtggaaaggcagaaattacaagagacacaatcataataagtgacctggttcagaaagcatctttggtcatatggacctaggacttctcttccccacccagagatacctgggcaaacacagagcactggtaaggctatccaccacaaagagtgactagcctgggaagcccgttggacgctatggccatgagaatccctccacttttacccagagacattggagcagctggagggtaccagtatagggattctaacacaataatcctatctaggaaacacttttatctctatagatctaagaaacccctactctacctagcagcaccagcaccctagtctggggaactccttctgcccactcagaatgtaccatcaaggatttttgagagtaccagcatcactagataaaccaagcaggcctcaataacacgagaaatactctgaaaataaaactgtctttgggaccacagcccataaaagtagaatggcacctgtgtattgaactacgtatggtaaatacctgctaaaataaaagattgaaataagatccagattctgcatatataatggacaaaatgtccagagtaccatcaaaagtcgcctgcatactgagaaccaaaacaaacaaacaaaactagaatgagaaaagacatcgactaatgctatcacttagataaattagatgttgaaattatctgacaagaattttaaagtagaagtcaggccaggcgcagtggctcatgcccgtaatcccagcactttgggagaccccggcgaccggatcacctgaggtcaggagttcaagaccagcctggccaacatagtgaaaccctgtctcgactaaaaatataaaaattagctgggcatgatggtgtgtgcctgtaatcccagctactcaggaggctgaggcatgagggtctcttgaacccgggagagagaggttgcagtgaaccgagatcgcgccactgcactccagcctggaccacagagtgagactccgtctcaaaaaaaaaaaaaaaatgcaatagcatttatgatttctgcaaagaaaatgaaactcttacatataaaactaacaaaacatgcacagaatctgtatgataaaagttaccaagtgctagtaaaataaataaagaagacctaaatatatggagatacattatgttcatggattggaaaactcaccatagtaaagatgtgaattctctctaagttgatctatttttaagacaattcttacgaaaattttagcaatgtttttgaacttacacaggcttattataaaaattatataggatgtatagaatggcacaggacctatactagccaaaactattgaataaggaaaaattaattagagaaatcactcttactgttgttaaagttaattatatagcagcagtattctagacagtctgatactggtggtgtacagactcatatatcagtgaaacagaatagagagcccagaaatagatccacaaatatgcccaatttatttatttttacagcttaaagtataattgatatacaaaaatctgcacatatttaatgtatacaatttgatgagtttggacatattcatatacctgtgaaaccatcaccacaatcaaataacaaacatcaattccctggaaaagtttccttgtgtccctttgttttggacgaagcaggaatccagtaaggagggttagcctttttaataaatggtgttgtagtaatccaacacccataggcaaaaaacaaacaaaaaacaccttgatctaaacatcagaagaacttaaactgtaaaacttactcaaaaatagaacatatttgggatctaacgttaaagtgttcttagacttgacaccaaagtcgccatccataaaaggaaattttgataaagtgaacctcattaaaataaaaaacttttgctatgcaaaatattctgttaagaagaaatataaccgggcgtggtggctcgtgcctgttaataccatcactttgggaagctgaggcaagctggtcgcttacgctcaggagttcgagaccagcctggccaacatgatgaaactctgtctctagtaaaaatacaaaaattagctgggcgtagtggcgcacacctgtagtaccacctacttgggaagctgaggcatgagaatcgcttgagcccaggaggcagaggttgcagtgagtcgagatcataccactgcactctcaaaaaaagaaaaaaatgaaatacgagctacagactgggagaaaatattggcaaaccatatatctagatatcaagaactagtatcaaaactacataaagagctctcaaaactcaacattttaaaaatccaataagaaaatggacaaaagacaggcacagatgtttcaccaatgaagatatacagatggcatatataaatgcattaaaaaatgttcaacatcaacaaccattagtaaaatggaaattaaaaccaaagtgagatattattacctagtagtcaaaatggctaaaataagaaaatagacaccagatgctggcaaggaagcggagaaactgggtaaatcatatattgctggtgggactgttaaatggtatagccacactggaaaatagtttggcagttcattttcaaactaaaaatggacttagcatatgacacagcaattgccctcttaatcattcttaaaaaaatgaaaacttgttttcatacagaaacgtatccacaaatattcatagcagccttatagtaccaaaacacacaaaaaagtcccttgatatgtaattgcttaaaaaaaaaaaaaccctgtggtacatgcataccatggaatattacccagcaataaaaaggaattaactattggataaacctggtgtaatttatactgagtgaaaaaaaataacaatctctgcttaattttgttgttcacccaaaagtcattcaggagcaagttgtttggtttccatgtaattgtgtggttttgagaggtcctcttggtattgatttctatttttattccactgtggtccaagaatttgtttgcttttatttcaattttcgaaatttattgagattcgctttatggctgagcatgtggtttatcttgcagtacattctgtgtgcagatgagaagaatgtatattctgtggttttgggtaaagtagtatgtagatgtctattaggtctagttggtcaagagtcaaatttaatccagaatttctttgttagttttctgcctcagtgatcggtctaacactatcagtaggttgttgaagtcccccattattactgtgtggcttcctaagtgttttcgtaggtcttgaaaagtacttgatttaggacattggtgtgccaatgctgggtgcatatatatttatgatagttaaattttcttgttgaattacaccctttatcattatgtagtgaccttctttgtccttttttactttactgtttgtgggagtgtaaattaggtcggctactgtgaaaagcagtttggagatttctcgaagaactaaaagtaaggactaccatttgacccagcaatctcattactgggtttatacccaaaggaaaatagattattctaccaaaaatcatatgcactgggatgttcattacagcactgttcacaatagcaaagatgtggcatcaacctacatgcccacaatggttgattggctgaagaaaatatggtacatacacatcatgaaatcctatgcagcaataaaaaaagaaaaaaatcatatcctttgcaacaacattgatggagctggaggacattatcctaagcgaattaacacagaaacagaaaaccaagcaccacacgttctcacttataagtgggagctaaacactgagtacacatgaacataaagatgagaacagtagactctggggactacaatcgaggggagggaggaaggggcaaaggctgaaaagctacctattgggtactatgctcactacctgggtgatgacttcagttgtaccccagacttaaatatcacacaatatactcttgtaacaaacctgcatatataccccctggatgtaaaataaaagttgaaatgtaaaaaaggaaaagcaacaatctaaaatgaatgtatattgcatgtttccatttgtttttgcttgcttgtttgtttttgagacaggttctcactcttgcccaggctagagtgcagtggtgcgattgtagctcactgcagccttgaagtcctgggctcaagtaatactcctgcctcagctttctgaatagctgggactacaggcacacaccaccacacctggcccatttttaaaaattgttttgtgtagacagggtctcactatggtgacagaccaggatccctggtctccagcgatcctcccgccttgacttctcgaaatgctgagattacaggtgtgagccactgcatctggtctctatttgtgtaacatttctgaagtaacattattatggcaaatagatgagtggttgcccgcttgtgaactcctccaccttgagggctcagaggctggatccatagatatagcagaatgtgtttgtgtgtgtgtctatgaaaaggagtaggaggctgagggtgggaaaatgccatggaagcaaaatatgattgagcatgactagcttctcttgtgactgttcagcccaaaatgtccaggagtcataaacacgttgtgaaagaaatttccagggcatgcatctcataaggacgtgtctgcttgtgggttctcaggaaactgcagaccctgccctgcaagtctggcctctctcatggacagtcagagggccatgaggttgcattttttaaattgaggtaaaattcacataacataaaagtaaccattttaaagtgtacaattcaatagcatttcgtacattcacgatggtgtgcaaccatcatctctattttggtccaaaatattttcatcaccccaaaggcaccactgtatccatttatcagttagtccacactcctccctcacccagctgttggcaaccacgaaaccactttctgtctctaaggatttgggtgacctggtcttcatgtcaatggaatcatgctgtatgcagccccttgtgactggtttatttcactcagcataatgtgatatggattgggggaaggtggcaggtggcctataaaaggataacatggggtgtcttgaggtgatggtacatctaccacttgtgttgtgcttacgtgaagtgatctatgtggtaaaattgagtataactatatatacacacacacatacacacacaaatgtatacgtacataaatggtgaaatcagaagaaggtttatggattataccaatgtcaattcttttgatattataccgcagttttgcaagatgtaaatattgagtgagcctccgtgaagggtgcacaggaccttcaacctccctatacaattttttgaaacttcctgtgaacttgtagtttatcaaattaaaaagaaaaattcaaacagccttagtttagatctttaaagcctgatcctaatgaaattaaattcattttcatcccatgtatataatattgatgctcaccccaatgattcgtagattacatatttttgacaaagaaagaaatgtaataggttgttactttcttttttacttacaataccagtatcattttgctgaatttaattggggagctctatagaatacaacttgaaaaatactagtctaacttatgtcagatgttcaaattaatgtagcttagtttcgtgctctctggacttttagacttcatgattcaactaaatttaaaacaagttagaaacaaaccagagatcaaccttgagttgccattttcttactttgctaattagggcttctcaccattgtaatataaaagaaaaagaccctatcagcaccaaaacttggaaggacctgatcacagaattaaaaaatgaaataattaaaaaaaaatactccagcctcttcatgtgtttcctgtttcaccatggcctgatgtgaccgtcatcatgcactggaacctgaatttaaacgcatgttaatgaactcctcaaatggcatttaccgaatcagagaaaacttgaaagaaacttaactagcagtggtccatttgagtaaaaatataatacataaaaggaagatctcttgaattccaagcctgacaaaaatttcatctttattagatggaatactatatatcccattttaagaggtatgcatatgtacataaatcggaaatttgcaagtaatatatgtgattttaatgaacttcaaagaaaacaatcatacaattgtatagtcacaccacatatatatgattgtagtgttagtaatagtgttttctgagtgcaaatgatatgtatatgtacgtaaacatacacagagatgcatgcatatatggaatatatgtgtatgcaagtacatgtcatatgctttcccatgggcaaatgattatgccaatattttcccaattttctaggatgttaacactcagtctcttttgctcaattccatatttaattttagtcctgttgaatcattaggatgtctttcatttagtccaagtcttactaatctgagttccatagtccatcacaatcccactttttctttggaacacttcctaaatagcaaattgccaatgttaagctcccttcttctgaccttctctagcattaattacacgtacctcaggtgttgacacataattatggtatgtctcagcttgtcccagaaatgatttttagtgatacatgaacatacgctatatacttttttaaatagaaaaataattgctgacatttaaaacggatctgaacttttgcttagtattaattctattcctcacaaaatcccacattttctgcccatttttcagatgagaaaagccaaagttaaaagggcttaaagttcgtgttaactcagctagtcagtggtagagctgagatttatagccaggttttctctttcccatgtgtgactctccaccagtattcattgctaattttatgagcaaatttgtagaagcatgtattcttttgaatgaatataagaatgacatttactaggctgtaccatacactgattcaatcaaaccaactaatttgcacaaaagcttaagtgaaatctctaagatttcatgcagcctgaattttaaatttggcatgagataggagactgccctttgcttagaaaacaaacagcacaacacgacaaagacataaacttgccccaatgccattgtgcgggagagcataaacctgtggtgagtcaaggctatagaaattaggttctgtggcccatctaatttgttgcccatgtcaggggccagcatgctgtccaggatccagctcattgctggcttcctcgctatgaaggcaatagtcttaggatccttgttataaacgtttggaaaaagtttctgaggccctcaaatcttcctggaggaggcagatatacagatatagcacataccaggaatctcagtcatgggctcctcgatggcagatcccatcagtagtgtttgaaacacacagtttgtacatcataagccccaaattttgatggctagtactaaaaattattttcaaagttgtatttcagtatttacataactattgagaagtgatttcttttgagagactcaaacaacagaaccttattttagctaatgaatttgtacatgcaattccctaattttcatctccctggcagaatggtttctacactccaccttatcctatagactaattacaaattaaccttactaaatattcatttttttctcacttcttcctttgctcacaaatttctagcatgtgccttacatgcatgcattctagttcagactaagactctgacctttcatgccaccttggatcccaccttatttctcaatattctcaacatgaattttctaaatattttcagcttagacctttaaatctatcaagttataattagtgctgacttggtagtggctaatatcactgtaatacataaagtataatgaagaaaatatgtgtttaagaaatatgaacagtagaattctctaggatttaccatcaaactacctgtgtgacctagagctaattatataaatcctgagcttccattttttccagtaatagggagatgacattagatgattcttaacatactctttaatatctttgacaaaaaaaacttcagttatctgattgcttatcctacttgtgtttgttttgtattctcttatgtatgctgggaaatgtgaatccgtatacaatcactgaattatcataatgagattcatctcctggcactggtgctaagattgagaatttttgctattgatggacagagctgtggtattgtgaggcaatatttcttattatattgcttttgttgaagttagtaagtagtataatcctgaaagcaaaataaaatgtggagccaaacaaattgcctctcatatttacagagggcaggccatgcatattacttcacattatgcataactgaggttgtaaaatactgctgtagtgttttgatgattcaacagttagtgttcttcctcaatcaaagagctgatgttaacagaacttgccacaatacagcatatgctaattgcgtatggcttcatgtgggcccttcaaatataaaaagtcaaacttttagaaaccactcaataccagacattcaaaattctgggtggcagtaagggatatcatttgatatttgaagtcaagaaccggattagattagttagagatgcaggaatatttgcaaggtctgtatgacctttacataacatgatctactggaaacctgtttttctaaatgtttatatgtatgcacattgacatttaaaatgaaaacaatgggatgtaaatcctctcattaagatgggtgccactgactgattactattcttgaagcaatgttgtcctttttcttgcatggtaaatgcttcttttttaaaaaataaaaaagtcattgctatgtataaaatgcatcattcagagattataaccagggttggaagtatcatatttgaactttagcttagacaagtccagaacatgttacaacagggtcactgtttgatgttacattgttgttcagagctcaactgtgtgttaggcctggactgaggacacagtgacaccctttattgctgtattgcacagttacatctcagggtaatgcttagaggtgggatatgctaatatagtagtctaaaatgtgcaatcaataattcaataattatttagggagggtcagataccacgctatgtgttggaaatacagtggtaaacaagactatttttaccctcatggtgattaaaatccactgtttttttttaaattattttaggatttgtcaatattccaagggcctaccgcaaggaagagcaagtgactaaagcttgtttctaatctttctctttttattcactatttttacctttcattttgtctcacagacatgatttgacccagtaatgtctcaattctttcccagaacaatgtggagataaccagatcataaacagctccacctctaattacaatctgcgtcattttcttgtgtgtgtgtgttttttttttttttcattttgatgtcattaccatagggaggaatcccacaatggggcaacaatcaccatcagttcctccacaacatgtggtttcaaccatgactcttgagaaagactttagctctatctcagaatattcccaataatttgatttacttaaactttatggtgcaaataatgtaacccatttcacgattctatctgctttattcttctttcgtcctttttgttctttaacatgtgactgaattataaactgccccttgaattcatatcagtcacaaaataaccttgataattacttcactctacatggatttctctataaatacatttcctctctgatcaataccaaccaactcaacatcgtccaagttctccccaaatccaatgaactcttccttctttgaatttagaacacaaattctatctcatgtatatgcatataagatgtcattggaaaaatgggggaaaagatcttaaagggatcagggaggctgggtatggaggctcacgcctgtaatcccagcactttgggagactgaggcaggcggatcacctgaggtcaggagtttgagaccagcctggccaacatggtgaaaccctgtctctactaaaaatacaaaaattagtcaggcgtggtggtgggcacctgtaatcccagctactagggaggctgaggcaggagaatcgcttgaacccaggaggcagaggttgcagtgagctgagattgcattactgcactccagcctgggcaacagagtgagactctgtctcaaaaaaaataaaaatgaaaaagaacacacatttgctttgccactcacatggtcactattcatgttttaacttaaatcattgaatggtcttattgtgttttcttttttttggtttttttttttttggttttttttttgagacagagtctcgctttgtcgcccaggctggagtgtggtggcactatctcggctcaccacaacctccgcctctggggttcaagcaattctcctgcctcagcctcccaagtagctgggattacaggcacccgccacacacccggctaatttttatatttttagtagagacgaggtttcaccatgttggccaggctggtctgaaactcctgacctcaggtgatctgcctgccttggcctcccaaagtgctggaattacaggcatgagccaccgcgcccagccttgtgttttcatatctaatgtttcatcacatggaatgcagtgttcagagtggagattctaggatagacagatagataattgctaacagtgcttaaaaaatattcagcatttgataaatatttgcttttttttttttagttttaggtaaaattaaggatcattaattttttacacctttgatcatgttaacatataaaagattaaataataggcaataagtagcaataaaataggaagtttagtttttccaaaaagtttatgatacttttattatttaaaaagaaatatataaaataatcacttggacactatgaaaatgttggaactgtaacttagcaattagaaatgcattagatacaaatgctatacagttactttatattcaataaatgttcattgatagtaattgctaattttaagatcttcgagaaaatagatacaatattgccacaaataacacctttttaaatacaccttggaatatcagggttataaatagttctttgtttggatgacaaaagtcttttttctttagccacagctgttgataatataaataattcatttttaaagcaataaaaataaatacagccaagattatattcatttatgtttgggggccatatatatagtttatagcataaaaaagcagtgatcttatgttgaccctttctctaaaaattaatagtttattcagcttcctgtgttgaaattgtttttgtttatatactattcccttatattttgcttatatttgctctctttttctgaagaccaattattgaccataaaattagataatcttggaaggtgttaacatttcctagttgaggacgtgtgcaacgggatggattttgctgccgtctagtttcttctcaagtgtctaagctgaggcgttccctactaaaactcaccactgtctggaaatcaaggcacttaactctctgttgtgagggggttgattgtaaatgtcccaaggtattgcaaaagcagaaggacccacgtagagccatgcaaatgagagtgggtagatacattttatgagtgggtgcctcctattctcagccctggtgatttttagggtggtctcaggtgtgtctcagggtagagaggtatagagttgccattctttgtctgatttttttttttccttgtctattgctttaggataaactcagccttactttactcacagctacaattttggctctcaaaagatagtttgggaaaatgttttaaaaatctgactatttattgtttcttgatgttttcaacccttatacaataattttcttttccttgaatacccattgatgatatatgaaaaaaataaggaccagaaggtgaagtgggaattttaaaagtatcaagataaaaacataagcgttatctcactagagacataaacccaaatattgtgttgatcagggtagagtaaagaaagcattgcccctgttaaatcacttatagctacgatccacttggtaatcattataaatctgtgattatatatatatacatatatataagctccatatgattttatttattatgaccttttattttacgtatatattagactctgaagagccccagggtatttgtcccaagatctttgcaaaactccgaatttgcaaacatcactaaggcatataattctactcataaaatgcagtaaagtatggctaattacagagaccccatcagactcttgatgattgtataaacttaagtcatatataacactattaaaataaaatctactactaaacaaaccacattgtattatatcaccccaattaaatttttaactatgaacttgcctcaatctgaaaataattgtagtgagcgaataatgatacttgctgtgtaataggtgcctggcatgttttctttaaagtaggacacttttatttttaatttcaacttttattttacatacagggagtacacatgcagatttgttaaaacggtatattgcacccagatagtaagcatagtacccaataggtagcttttaactccttccccgccggtccctccccactctagtagtccacagtgtctgttgttctcatgtttatgtccgttgtgctcaatgtttagttcccatttataagtgagagcatgtggcatttggttttctgttcttgcattacttcgcttaatataatgtcctccagctccatccatgtcgctgcaaaggacatgattttgttcttttttatggctgcataggattccgtggtgtgtatgtactacattttctttatccagtcaaccattgatgagcttttaggttgattcgatatttttgctattgtgaattgtgtgacaaagaacataccagtgcatgtgtctttttgataaaatgatctattttcctttgggtatatactcagtaatgggattgctgaattgaatgatagatctgttttaagttctgtgagaaatctccaaactgcttgccacgggggctgaaataatttacattccaaccaacagtgtataagcactcccttttatctacagcctcaccagcgtttatcttttgattttttttttttttttttttttgtcacccaggctggagtgcaatggggcaatcctggctcactgcacctcaacctcctgggttcaaatgattctcatgctgcagcctccctagcagctgggattacagatgtgtaccaccacacccagctaatttttgtatttttactagagtcggggtttcaccattttggccagtctggtcttgaactcctggcctcatatgatcctcctgcctaagcctcctacagtgctgggattacaggcgcaagccactgcactcagcctttcttgacttttaaataatagccattctgtttggtgtgagatggtatctcattgtggttttgcttttcatttctctgatgattaatgatgatgagcatttcttcgtatgtttgttggtcgcttgcatgtcttcctttgagaagtgtttgttcatgtcttttgtccattttttaatattagacttttgtcaggtgcacagtttgtgaatattttctcccattctgtagattatctgtttactttgttgatagtttctttggctgtgcagaagctctttagtttaattaggtccctcttgtcaatttttatttttgttacaattacttttggggacttagccaaaaattctttgccggccgggcgcagtgcctcatgcctgtaatcccagcactttgggagaccaaggtgggtggattacccgaagccaggagttcgaaagcagcctgaccaacgtggcaaaaccctgtctctaccaaaaatacaaaaattagccgggtgtggtggcagacgcctgtaatcccagctacttgggaggctgaggcaggagaactgtttgaccccaggaggcagaggttgcaatgagtccagatcacaccactgtactccagcctgggcgacagagtgagactctgtcaaaaaaaaaaaaaaaattgccaatgccaatgtcaagaaggacatttcctaggtttgtttctaggatttgtagttttaggtcttacattaatatctttaatccaccatgagtttatttttgtatatggcaaaaggtagggatcaagtttcattcttctgcatatggctagccagtgatcctggcatcatttattgaataggaagtccttttaccattgcttgtttttgccagccttgtcgaaggctggttgaaggtgtatggctttatttctgtgttttctattctgttccattggtctatatgtctgtttctgtaccaatattatgctgtattggctactgtagtcttgtagcatagttggaagttctatagtgtgatgtactgtggtgtgaattattgtagggtgaagtactgtagtgtgatgcctccaattttgttcttgctgcttaggatggcttcggctatatgcgctcttttatttttttttttggttgcatatgaattttagaattgttttttctaattctgtgaggaatgaccttggtagtttgataaggacagcattgaatctataagttgttttgtgcagtatagccattttaattatattgtttcttccaatgagcatggaatgctttttcgtttatctgtgtttctttcaacaatgttttttaatactccttacagagatctttcagcatcttggttaggtgtattcctaggtatttcattttctttggctattgtaaatgggattgtgttcttcatttgactctcagcttggtcattattgttgtatagaaatgctattaatttttatatgttttactataaaaatatatttttatgtattgtatatcttgaaacctcgttaaaattgtttatcagttctagtagccttttggtggagtctttgggttttctaagtatagaatcataccgtcagtgaaaaaagatagtttgacttctttttctatttggatgcattttatttctttctcttgcctaattgctgtggctaggacttccagtactatgtttaataaaactggtgagagtgggcatccttgttttgttccagttctcagtgggaatcgttccaacttttgcccattcggtatgatgttggctatggatttgtcatagatggttcttattattttgaggtatgttccttcagtgcctagtctgttgagggtttttatcatgaagggatgttggattttattgaaaacttttttctgcattaaaataggacactttctgtctatgcttagcgtcttgtttattcttatctactttttacttgatgagatgtttcttcgcaattaaaaatatttaagtgacagtatagccacccatactttttattacagaaataaaaaatgcttcgtctctcatctgtcatttgatgaaaaaatccaagactttcttctaaaacctgcaaacatcataattcatatttgtattgcctccaactatcttctttcaagttaaccaccctttcaactttcactaaatctttaactcctatttgacgaggtattgaacgctgtactcaatgaaacacttttgcagcttctcttttggttatttatttttctttggttttctatagagaacataatggggttgaataattcaaaaatacaaactcttgctgatttcaacattgcacttttaattatattaaacttgtacttcctgggtcaaaaatcatctacgttgtaagactctttactttttctacctttttattgccagccttgtcagctatctttagggtagaagaagtgggagagatggtaaagcaatgagttgtgatttatttttctcaaaagaggaaagtttgcttcaaatcaaggaaatcaatacctacataaaaataaggggaggccaaggctgatttaataaagagaaagctagagtttcatcttgaatctctcactagcatagcgacttatgtatgaacctcagtaaatatcaatattctagacatagtggggcttcggtgtttctcaggaatagtcagacacatcagtatttaatctataatttaataaatccaagggtcttcttatctggaataaagctgactaaataatttagttgcttataaagcactaatatttagtactaaaatgacctgtcaatgttatttacatttattttatgttaactgaaagctatgttgctgataaagcttatattaagttcaggagttttaacgtggaattctattaatatggactcttaggactcaaagtgtttttcattaaatatcctggaacgtatgatataaaaattgagagatttatctttacgtattttgttctgcccatattggtattttcagcttattttctatcacagatttacatgggccaagactgaatcatagaatgggatattggaatttaatatagtttgttgatgctatggaatcattttttaaattatcaataacttattggatcttttattgccaaagtttcctaggatttcaattgaaatgcaaaaagaagaagtaaaagacattaacgtaaattctcagcagtttatacaaataaatttacaaggggcctatggaacaatacatgttggttttattttcaattgtagcaaaaaaataaataaataaaaggtagtttgccaacctctagagtgttgtaataatggcatcttttgacttttggagatttcatggaaattcttcaggtttccaacaagagccctccgggtgtgttgaattcatctgtacctgtgacagtcaggatctaggcaaaattcagaaaaacagtgagtacactaaatatagacttgccaagtctacagttctttagggaaaaaaaaattcctggactcagcctaaagtccccctaagttttagaggtcagtaatatttcaagtgactagaaaatctgaactaggtacatcatctttgttctcacacttagtatgattgttctcaccaagcatcattgcttttctcctttctgcataatttttccttactccttgattgccctttcactcttatgtgaccataaacctctgagtttccataatgtagacatgaaatttaatggactacattatgaaaatatttttttcaatgtcatcataatttctgtgccaggataacaagctcagaatatgggagtttatagtccagcatctctcccacaacctactatgactgtaaagaaattgtaacctgctccttatttccttcaatgctaatttctttgaaaattgattatgaatgccctccaatcaatatatgtaaaaaaaaaacctttatctttactaaaatacatatcctccagattcataacgaaggagaaaattctttggggaaagaagagtggagacccctcagtttcaattctgatccaactgactttattttgtccctagggttattttgctggttggtggcttaacattctaatcctagggtaaactaggacctgccttgccccttaacaacatgtgtaatcttaaatctggcccagtcaaaagttttaaacaagactttaggcggtaaaaactgaaagagaaataaaccaggaattaacaatgaactgataatttttgctgatgaactaccacttggcttacagagattagaacacatctttctaatcttatgacacaccaccctaggctgagagtcattctagcaccatcttcgtcacctactcccttgaaaggtacatgaagttttatttcctttcaaaattttatttttttatttttggtttcttgtttttagaattattatctggcaaggataggactttatccatggactcgacagtgcatttattttagaaaaggcgtgtatatttgtgcaatttatcctagcagagtaagttccaatatgtatatacaggccaaacaatgactataatatgtacatttttcttcattaactgtgttgattgcctgtgttctttcatccagcagaggcaaagtactaacatagaagactatccaaagtcttccagtagacttgtttagactagatttgaaagaagatcttaagtgtaagattatttttatactgttttcaacttgtatatttgtgcaatttgttgaacaaatgagaattagataaataattttaaaatataagtactttatgagtcagtttcccttttttgtaagttctgtttcccagacgtgcaaagcaatataattcttattatttcagggtataaattaaatttaacctgagcaaacaacttcttgtatgattgtattactatttttattactattatttttagagagactgatgacattctatcacttggtgtcatattcatctttttatagatatttgactaataatatgtaataatagtattatgaatggtgcccttaagtctgatgatttgcttaaggggctaaagaacaatatataaatggaaatctaaatagcactacttttaaaaagaataaacccatagaaagaaaattccatagctcaaaactaagaaactcaaaatccatataacacagaaagtaaaagggagcagttttctatatatatatatatatattttttaaaaagctctctgactctggttaaggatgcttgtgaatctaaaatgatgcatgttgataaagcactgtaatttaaagaagtctccagtcttgcctttaacagcaaaagcaagaacacattaaatatataggatctataagagaaatgaataaaaaatgttcaaatggaaatggtaaacatacagactagttcttaaagataggtcatgtatattcattttctaatttaaattgagctattttgatacatgtatatattttattattatgaaatatgtcaaacaactggaggatgactaaaaataatattaatataacattttgccgtacttgattttagaatggtggtaccaatttatgcctccaacagtagtgtatgcatcccccatttttcaaattcttatcaactagatattgacactttataatttttatcaatttgatgagtatgaaattatatctcatttgttttttgatcaatgtatcttttatattcattgaccctttattatttcctgctctgaatcatctgttcatgtcctttgccaatttttcaattgacttttggtctatttcttattttcatgtaattctttaggtattacagtttttccctttcactcatcggtctctaaataaacttggaaataatttttaggggtttttttgtgaatagtgaataattttgtgaattattttagagtaaataactgtcctaccatcattgtttaaatgtctaccttttctctattcacctgtagtgtcacctctgttttgcatcgagattagtatatacatgtacattagattagtatgtacattagtatttctgggcatctttttttgttctgttcttcatttgccaattcctgtgccagtactataatatgtctcaattaccatagatttatatttagccctgacatgtggtagggccagacaccctaacttgtttttcttcaaaactttcttagataaaccttgccctttgtctatcatcagttctataaaattatcagccattatctttaaatctggcttctctgcaattccattcattctcttctttaggaactcttattgtcgtataatattgtccatcttttatgtccttagtattttatttttaacatttacttgcctccctgtgttacgttctggatgaattcttcattagtatcttctaattcactaattttatcttcttgttcaatccagatacttaagctgtttatttctttaaaattgattcatttactacatttttcatttccaacatttatagcttttttcttctcaatatgaaattattttaatttctacatgcttttgttttataactacttgttctttttattgagttttatcttttaattttattgttgagaattctaaacatattatttaaaaatgttcttcagacatctatatgagaataatttcatctagactgaactcatggttgaatcattgtggttgtggtggtggtggtggtggtggtggtggtggttttctgccttttttaggcctttatttattcacagatttctggagcatttagagtaaaagggtttgcttttattgtcattgtgtttattatatctgttccaccactttgctgttgtccccatctggcccctggaatagctgcctagattcagatagtctactaccacgtggagtgctgtttgtggtgataattaattagaaatattgaagattcagtactcaaattcatttgttttgggctgcttctgccttcatggcgtgtgtgtgtgtgtgtgtgtgtgtgtgtgtgtgtgtgtgttcttcccgtatctctagtgtaacagattcctaacataataggctctcaggcagcaggtcagcaaaatttttaagacatttttcttttcaagaatgattgctgggtgaacttttgccataacttgtgacttcaagcagtgatcttaattctagtttatcctgtacatgtggactcttagtgaaggaatctaaatgcgaagccactacccatggggggaaaatagtctgtcaggactgcagctactgtgtctgatatgtggaggtgccaagattgtgtctaagtcctactgtgttataacactctttctttttttatattttctttcttattcttctatatattaaataagtgtcaagtcatgaaatttccatgccatcttaactgaagaggtttaaatgttttatatttaatctcccgttatttattgactttacaatgtcaaattaaaactcacattcaggcatatactactaaaatactaatagaagacaaactaggatcattatgtttagggaaaaatacacacatactatcatgacacagtacaattaacataaaaccaaacaccagaggtttctcttattaaagctgaattttaattgtttttatgtatctatattactgtctataatacaggttcttgagaattaggactgctgttgtgtgtgtaagtgtggatcgcttttgttgtaatttttgatcatacttctggaaactagcatgatagctggaaaacaggtccacaaatattaattgaatcaatgactgtttaggagacacacaggcatagatgcagcttctgtactacagtaccttacaacctatcatcgacaaaatacaaaggcaataagtactttttaaaaatatataattgtataaagtgatgagcaagaaaacagaatgaataagaatgtgtaatagtaaattaatcccatttcacttttgataggcttttatataaagctgatacaaaatactttttaaattctcagtgaggcatttgatgagtttcctaataatatttatgtaaatataatagcaagtatacaatcttctctatattttgtaacagtaatgactatccctttaaaaggtatctatttgattcagaggttattatttttctcttgtcttcgctaattttaattctctgatgatgttttgagaacacatcacttgaagatttttagtagggcagtgctgttgtctatgttactgaaaagtaactggactggagaatgtgaacatgcactcctgttcagtatttggattttaggagtgtgtcgctgattcttgaagaatttttttaaaatctttttaagaaagcatcattattgttacttaaaaatatttacctgttaagcacctcttagaatggccaaaatccaaaacactgacaacatcaaatgctgaccaggttatgtaacaacaaaatctctttcattgctggtgggaatgcaaaagggtacagcctctttggaaaacaatttggcagtttctcacaaaactaaacacacacttatcatatgatctagcaattgtactccttggtatttacccagataagcttaaaacatatccacacaaaaacctgagtgcaaatatttataattattcataattgaccaaacttgtaaacaatcaagctctccttccataggtgagtgaatgaatgaatgaacaggtacatgcagccaatagaatattattcaggacctttgaaatgagctataaagccatgaaaaaagaccaacaaatatgggggaactgtaagtgcatattactaagtgaaagaagctaatttgaaagggttacatactgttgaatttcgactatgtggcattctagaaatggcaaaactatgatcacagtaaacagatgagtggtttcagtggttgccaggggttgcggcaggaggtggaatgtatagacagattacagaagatctttaaggcagtgattatatattatccgaaatgcttgcgaccagaagtgtttcagatttcctttttttttttggggggggggggcgattttgaaatatttacattacacttaccagttgagcatcccaaatctgaaaatttgaaatccaaaatgctccaatgagcatttgctttggacatcttatcagcacttcaaaagttttgaattttggagcatttgaattttagatttttagatttgagatgttcaacctgtatgattctatagtggtggacacatcgttgaatacttgcccaaacctatagcatgtacaacactgagtgaaacctaatgtaatctatggactttggctgacattgtatcaatgtaggctcatcaattgtaacataccattgtggtatgaagttttgatggtgggggaagctgtatgttcgtagggctagatggtatatgagaaacctctcttccttccacttagtcctgctgtgaacgtaaaactcctctaaaaaacaaagtctatttttaaaaaaacatttactaggacaaaacatgtttttagcacaattttttaaacgcacagtaaagcgccatatgctcatgagcttcctttggaagcgcccatcttcaaacaagtatattaagataagttttgtccatatcatagcaggtattttattttcccattctgcatatatttaacatggtaattaattcagcctggtattactctggctgttattcaaagcctcatatatgtttgctaatttgtcacttgctcctcatacaacatcttaactatttaataagcagttaccaaagtctagacagtcctgctccagcatgagttttaattgagtatgtactacataagacaattaagatccgaacaaaccatcagcggcagatgatcctacagttatgaggaaagcttctgtaggagtgactgtgtaaaatgatgaaagcaaagggtcttggaatatcatatatatttatatcagggctctaaagacatactaggataaagtggagaaaggcatctctagggctatcttctgtcattttgttgccagtcgttttaccatcaaagcaatatttttagaaaaaggtttccatcatcatttaccaatattttagggaatctttaaagtctaagaacaaatcagaaggtaataataatattgaaaaattattccaaaatgtttagtacgttgtttgtcttgtttcatcaaaactatttgtagtagcagaacttttgttggtggttctgtaactgatgattagctttcagtgcaagtatttttcaggtaactgtgtgaaaatatttttaaacatttacactatgtttccaaaccggaacactttggtatagttatacctgtgaaataaatgacattgtgtaaaacaatatagcggatcttttaaagtgagttgacaggatgacagtacagttactcacagttcaaactaccacaatatagaatgtaatgagccataatgctattatttttcacttcagaattttaatattgtgttttgtacagttcttaaaatgtcatgcataaaacattgtgctgaaacaatagtgatttgtatatttattacgtcagtaggacccaacagtctaataacgataggaaacaatggaaatttttcctcagacttttttggaaactggttacacaaagaattgctttgggaaggatctaatgtttgaaaagcattctggcttgatctttagatacaacagtttgatcttttgtgcaactgagagcctctatataaatgcagctggagtgagtagggtatttgaggctatggcaccttcagtgatagggtgatttttgtcttactcatcctcagtgccaaccagaaaataattacattcctctaatagtgaattgaccactaactaaatctgaaggacaagaagcttggaaaaatataactgtgcaaaatggcttatcgaacttaccattttatagaagttgaacatggatctctaataccttggacttgcttctaatatggtatcacatagtttcatcaccgtgattactaatggatggagtgatatattttatttccaagtattaataaaacagcaaattatcataattgaataagaaggatgctacattgcatatttaataacgtatatgtgacactggacaagtaaggatgaattaatctcttggaataaaccaccattgaaagagcgtttctgtcaagtaatgtcatttactctccttattaacaaacagagcaattctgttggatcacttagcatggtgagcttattaggaaaatcacattggtttcagcaaaagactcatgtgacctttctaaatgaaaatagcatgatgctaaaaaaaattggagggaggaccatctctacatacagaatggtctttgcaatcaactaccatattgagaaaaaacttttattttttatgtttagaatatagaagggtttctgtttctcttttaattaaaaggaacgaaagtggtatttacattaaatgcaaatagcaccttctttcctacagtgagtgtttctcagaaatggacacattttcccttctcggtctccagaaaccccttgatcacaccaaaagagcaagtatggctttctgaaaatagaaaaattgtaggtaggttatacttacagtccctgaatttttgcacatatcgtaaaatggtgactagaattgttcaagatgtgttactccgttacacgtttacaaaggggctgaagagatatagatgttgcattttattaatactaaagaagaaactcagttataggaagtaacaggaaaaatgaatagtggtctgcatagtaacaatatcataatactgtaaagaagaaacattgcacttgccatttaataattgagaaaatctagagtgaattattttgagtaagatacacttactattaattttttctaaaatgtatttctctaactacatgttagttcaggtgaaacaaaaaatgagaatttaataaatgtttatatctgaaatataaaattaatatgtaaatataccttcttttgagatgacaggtgtacattctcggttgaaaagtaggtttctattttaaatcaagattaatgtatagtttatgattaatttaaaatataaatgttatatttcctctcatcctagaacagaataaaaagattttgaaggatttgtattaatcaaataagctagaagccacgcttttctaggaaaaatattaagagaaatgtaaccatgcttgacgctaggatggtgttaccatcaaactaaagcataatttcctctttctgtgactgttgaatactaatttttaaacattaggaattgtctattatactttattatatcatgactactcaatgttttgacatgaaattgtccctaatatatttgctaatatttgaaactagttcaaaattatctggcaagaaatttgtggctttatccatatgatgtatagcatgctagcttgtctatgcagaaggacaataattagacaattcagagaaggtgataatatttatagcttattatagaaatatatgtaaagactttcttgattgtaaacataaatattataaagtataactgagcttttgagattatcaggaaaccaaagtatctacaaaatctaaactttcactcaaacccatggtcagactgtcaatactaaattgaaaaattagactcctacacaagttgtgaagtttttctttcttcatgcatatgattacagaaaggcaggtatggatggcctaatttgtggaataaatccaaccacttttgtaacagctcagataacaaaaatcactaatagagaatgtgatattttatcaaattggctttgtttttgtttttattgtagcattgcataagatcaaagaagaaaataaatgattcaattaaaggaaaaatactgaaaggcaggacacagaaaaagagagttttagatgtggaattcttttgagagatcatctagtctgtttacagatatgaaatctggggaaacacagaggtgaattgtccaaggctttgcagttattgaagcatcaaaatcatacatatatcctgcttctaaacctccctctcagtgttcttttcatctatggttttaaaataatcaagtggtatttgttaagaagttagaattttaagatatggattatataaatccgatttatatggtcaagtttgactaatattagtaaatttgattgttagcaacataaacatttctggagtacctttcctataaaatacggatgacaatctcctttagcattgttattccgtctgggataaaaagcacttcccacatttatttagaaatgtaatggatgtgttcatttaactccaatgatataataattctctattgactacattcagtataacagtgatgtttatttggaattccccttggacttccacttagatttgttaaatatgaggtgatttgaatgacttaactaatgacatttgctcaatgtcttaagtttttcttgatagttggtaaatatctgttcatgatcaagagtgttacaccaagaatttactttcaatagagtgccatagatatcacttactgtgcattctctgtgtttatgtgtaaacatataatagatattcaaaagtaatataacctctccacattataaaataatgcacaaatataaagaaggataatatataagaaaataaaatggtgtaattgcacacgtgaggtgttctattttatgtcaaactatttcttaaaatcattcaaatatcttttaggttactaaaggagcttttgtcatatgaaaatcatatgaatagaccatcacattttgcaataagaagaaaaaaaaatttaactcatgaaatcaaaacctttatccaaaaccacctttgttcctcaatcttgtccaaattttgggtttttctaaacaagttttaataactcttattattttatatatttaccaaagcaatcagtctgtataagatttacattttagcatgctgttttttctctgatttatttctttcgaatcatcacatcaaataataaatcttaaagttgtcaattaaaattgatttcaaatgttttgtatctccccactattataagaactatattgtgaagtctatatcaaaatatagggggaaaagcctaaggtcgcaagtgaaaattttttttctaagacacattcaaaaatttgctaaccatttttgcatatctctaatttgccccagaccccaaattttaggataatgataaacttttagaatttgttaatacaatttttataattgaatatatcatatcttttttcaagtctatgttttttaataaacctgagagcaaatatttaaaatctcttttaaaagcatccaaatcgtaacaaaaagaactgtacagtgtaaacaatagtgtatgctccagacaaacaaagccttgtgatgtgaaataaagcaaatttgtgtataattaagcattaccagtactgttaaaatataggtttataaactggcaagaatatcgggaacatattctcagatattcaaatgcaaaaatggaaaatatttcatttttaacggtgaaattttctgctaactgtttacaaaataatatgtacttatatatagaaatgagtataagctattttcttttaatggctagtttctcattaaagggatcatgacattaggcatattaagagtttagtttggaaactattttaaaatattaataaagagctattgctaattaatgatgggattttccagttttatacatgaataaattactattaaaataacaaaaattgataactaagaatggggattagagtttgaaaaatttcattagtatttatggatttattggtttccctcattagagactagatgaccatcagagacggtgatatttttacttcataaccgcttatacctgttgtaaaatatcgagaggccatcagaattttgtcacttagagaagggactggaaatttttttaggtattcttttgccaagcatacttgctctatttaatggatgagaagtaaagctagacagattttcttcagttaaactttcaatatctccacagtctacagtacattaaaattcactcattgaaatttttttgtttgactctataatgataaatgtatctatttttagcattaataaaatggatgaagctttaactctataataaattcttccactttaaattctatacagcttgtctttccctgattctctagttctattaaattagtagaagtagttcgtgtcttcataatcaattgttatcaagaactaatatgtctaaataaacctgtagataaatgtccattcattattcttggtccataccaaagttccaattattatttgcagtatgtacctgacatatacatactaaaatgggttcaagtatagtttctcaataggaggtggatccttttattgatacataatagttgtacatattttgaggtcacataagattttgctgtgtttatgtaatgtataatgatcaaatcaggataattgggatactcatcacctcaaacccttaggagatggatactctcttgatgttcgatatttttagttttactttgattttatttttgtcatggcctcatttcaaactgactcataatccagaattatccaactaaatcataacagaaagtattattggctaaagtgaatcaagaaaaaatttagcattgttgctgtcatatacaaacatgtaagaagtttctttcacattttaaatataaatataaatgactgattctgggtttttcccttatgaggaaatacctaagcaacattaagctaagcaaataaatggttatttgtgtgatgatcttctaaatgtgtgtgtatgtatatattgctttaataaaaatttcagatggtatatcattttttaagtagcgaaattatcatagtgacttgtgaatagcaaaatgcaaaccaatgtggcattggatcctctccaggatgtgatgagtcacctgtcaccccccccattcaaccccaaatcccctacattctcagggaggactagttcttcctaaggctaacatgaatgccacatgttttaaagcaaagaatgtagaacatcaagttttaaatgtcatgtccattaatgagattagttaactgtccctttgcaagttcaaggaacaaagaaagccctgtggagagcagagagaagacagataggtggctgttaatgataagaggcaaaatttggtaaagggaaggcaacttaagctaaaggaagtgagtgaggtggatagaccccactaaaagacaaaaggagatagtacttaagaaaaaaatctgtcagtatctctctctggtagctgccttgtttttgttttgttttatttttgtttgttttatgctttcctgtaaatcatctcaaaatatctgactgtagcttcctctttcactcatttcattctgtaaattgtttctcaataccatgcctcttgaacacgagaaaacgctgtttctagcttcatcttcaagatatttatttccatttgtaaaaagaaagctgaaacatttttataggctacctcagagattatatactaacattttagtaacatgttctaaatgcttgagtagtttaagtattgacataaaattgctttctatttcagttggaattgtttgaatcctcagtaaatgtaaactattgtagctctaagggtatccccaactagaaagttcttatttcacacattaacatttgctgctttcttcacaagttaaactaaacatattttccttatttatttatttcactggaattcctttaagacattattttctcaagatgtggcccacaagccacctgcactgccaaccacaggttttctcagttggtatctctggggagaagaatcccttgatagtataaaaaatatccaatataccattatattaaaaaactagattggtcatatatctactgcatataacactgatggtcatatatctattgcatgtaacactatatacctgaataccagataaatgtagctcgggaaaaaaggtgaattatttcatgtagcaaggagtgcagaggtagcttttctgtcattggtttaggcatctcaatttcactccattccaggcagtccctggcagaaaaagaacaggatcaacatgattagcctggccaatcatgatttgttctttgggatgagtacattgcttgtgcacagtctcccttgatacccgaatggaattggagttctgttgacaaagaggaggaaactggatgggcaggtctagagtttatctggaatttgaattgtgcatttttagacatagagaaagaaatgcatttttagacatagacaaagaaataagtaggttttattatagtacgcactaacttaggtcagtttctatgtttctgtgactttcttaatcttacataattacctttatcttattaattaattaatttttatttttgctacatgaataaatacattcaagagggcacacaataaaatatagtaatatataattccaaagtacgggctcagcaagtagaaaaaataaacaccatgatttgaaagcattgatgtaaaacttgatctttaccattgctaattagtcagccagaaaatatatataggaaatggcttagccctacatataaaatgtgattctcattcttagggttatctatgcatcttttatctggtactactttttatatctcaatatttgacatcttttttgccccatttcaaaatataaatttatttattttctttacaactgcattcctctgcacaaataaaaaatatataatttagaatatatagtagagttttgataattatatttatattttaaatggttttgatatgaatagttacttctattctccacctgtttaacaaatttgatatttggaggcaaatttccatatatttgaataaatatgatagttaagaaagcattactttctatttgccaaaacttaccttgaattaaaaatagacaatacgtatttatatatgtgtttgtatatatgtatatatgtttgtgatttgtaatggttttgtatatgtgtgtcttctaatacaagggtccccaacccctgggccaaggaccggtactggtctgtggcctgttaggaacccagctgcacagcaggaggtgagcagaaggtgagcaaacattactgcctgagctctgcctcctgtcatatcagtggcagcattagattctcataggagagccaaccctactgtgaactgcgcatgtgagggaaataagttgcaggctccttatatgaatctaatgcctaatgagctgaggtggaacagtttcaaccccaaaccacaacccctatacccccagattttcacctcccccaaacccctgtctgtggaataattgtcttccacaaaactgttccctagtgccaaaaaggttggggaccactgttctaatacacacatacacacacatacatacatacaagtgtacattgatatatatatatatatatatatatataatgaatagtttactactatgtgggctattatacagaactgaaaaaagaaccacaacaacacaaaacaatatcgatgaatgttagcagtataatatccaaagaaaaaaataaatccaacattataattcaaaaaacccaatattaaatccaataaatttaataaaaatgtcagatggtgcattctctgagtacagtatcccttgatacctgaatggaacatactacatggtaaatatcatctccataaagccaaacatattgaaaataaaattttagtctttaggaataatatgtgtgtgtttaataaacatataaaaagaaaagaaatgatgaagaaattattcaaaactgtgttacttcatttggggagaggtagggaatgtttgcaaaagtgcaacatgattggacataggttattttcaattccttgcatttttgcaggagtaaggagtgtttgcagctgtttcctacgttgttaaaaatgggcaggccaagagtgcaatgtatctttaacataatgtcgtaagtaatatcccaatcaaatcaaatttatgtaagtatgtcttatgaagtaaatgcaataatgatatggggagcataaatgctacataatttgaatttaaatgagagcaattggccaggcatggtggctcatgcctgtaataccagcactttgggaggccaaggtgggcagatcacctaaggtcaggagttcgagaccagcctggccaacgtggtgaaacccggtctctactgaaaatacaaaaattagccaggtgtggtggcagatgcctgtcatcccagctactagggaggctgaggcaggagaatggcttgaacccaggaggtggaggtcgcaatgagccgagattgtgccattgcactccagcctgggcaacaagagcaaaactccatctcaaaaataaataaataaaaataaataaatttgagcgataataaagggtggttatttgggctttgtatggaaagttacttattttcatacagctttctatacatacaaatttctgtcaataacaagattgaagaaacatagagtaataaatacaaccctctgcattctgcaattttcctaattcaaagttacattttcacatgctgaattgcatttattggctttatgtttaatactaagcttggcacatactatataccaaaaataattttaattttcaaattgttgattttttaagttgttgccaatgatttatctaatttgctcatgattctggatcaatcatttctgggttgtttcagcaaatcgttaagaacatatctaaattagagttatatattattatgtatagctgtatcatttactgaggaattactaacaatacttttcattttctagataaaattcaattgataggataattttctcttcctctggtaattatgccataaataagcatacttctaacatttattcctgtgaaagatggagagtattttttaataactacattcatgaatgtcactttctaattttcagagtttctggtctgtaaaaaaatgacaattagttttactaaaaataaaatgtgagaataaaaatgggtgaaaaaataaaatagagcacacaacatactcctatctgtgaaacttgtttttaaaacaaaaataaaataatgataatttcctcatagaaaaaaatggaaaattaggatttttaggtgaaaaattaaaagttaattttcttagaaaatattatttattctcgcggccaggcgcagtggctcacgcctgtaatcccagcactttgggaggctgaggtgggcggatcatgaggtcaggagatcgagaccatcctggctaacacggtgaaaccacgtctatactaaaaatacaaaaaattagtcaggcgtggtggcgggtgcctgtagtcgcagctactggggaggctgaggcaggagaatggtgtgaacccgggaggcggagcttacagtgagctgagatcgcgccaccgcactccagcctgggccacagagcgaggctccatctcaaaaaaataaataagtaaataaataaataaatacaataaaatattatttattctccattatgagcatgagtcttacagtatggcaatcacttgtatttatacagaatggacataaaaatgaatattttgaataaccaacttaatttgagagtaaattttgatataacttgtcatagttatgtaaattattttagggtagttgataattgtgttctatgaattaaattcaactatcatgcaacccagtcttaatttaccaacataaaaatgcttatagcatttgttagttaataaatatacttcatttgcatctacagctgtgcataaaatcactattcaggatgagtcacatatatttttaaatatctatcacaagtagttagtgcaaataacttaaaacaaaatatattttctgaattagagtctatgagaaattttagccacattaagtagaccaatttgggattaaataacaataacaacaatgataataataatttatccattgaatgatatttacaattggttttatagtagaacaactataagatacaattttcaatacacttctcattcttctaaacatatggagtacagaagttaaatatattctaggaattgtactaacagagtattttatatttcaatctcaaaaattaaaaatatttccccaaagctaaatatgataaattttcaataggcaaattgaatgaacatgtatttgctactaaattttaagaatataagaaacaaaatatataagaaaattcaggttatctgttacattgtaatgcttgtaatggatgtgacggataggattttggttagtttatcaacccctggctgtcttacttaaaggactgattcggaatataaaagtttaactacatgtgatgtgacttgagtattgctcccaagctacctttaactggactcaaggaagaagaaaccatattcaactaaaattgataaaagttcattttcaatgtagaataattcatttatcattcagtgttcttgaagcagtttaaggctttgtttaagtactaaaacagagtttgaagaccgagataattggccgggcatggtggctcatgcccgtaatgccagcactttgggaagctgaggtgggcagatcatgaggtcaggagttcgagaccagcctgacaagcatggtgaagccccgtctctactaaaactacaaaaattagctgggggtggtggtgtgcgcctgtaatcccagctattcaggaggctgaggcaggagagtctcttgaacccggaaggtggacgttgcagtgagctgaggtcgcgccaccacactccagcctgggcaacagagcgagattccatctcaaaaaaacaaaacaaaacaaacaaacaagcaaaaaaaaccaaaaatgaaataatttctctaatttcatttaatgcctgagagaatgattcttatgtataaatttttaaatggctacttatagacattgatacaattatactttattctgttcatcagtgtcctaaattgtcaagtaacagaattcactatctctagggtaaacagtaagggccacactaaagataatatcaaagactcttggggagcagaagaattagaaatggtggcaaagagctaggagcaacattagaaacacaacacagccaggaaggcaacgatatcactggaactgtataaatgaaacaactctgttgccactgttagcttgttgaccctgatgatgctgaggactagatggcagaatggtcaccacagcaaccccagggaggcccaggtgtgttctgcactggccagattagactaaatgctcactgcctcaggctgtttagtactgtatcttaatatcacatcaggacatttgatcagtgaaacaagtttctcagatattccaccttgaaaaagcaggattcataattgagcatctatcaaatgtaatgtacgtatttaaaaacgattaggtcacaaccaatggggatatgtactacatttcattaacatatattgaatactagttcaaatacttctaacattaattcctagagtattaatgtaacatgtcagtatggaaaaaaattccttcatgaaccctgaaattaaagagtctacagtttcagttttgtagtgttcctagttacagaagctagatttttatttttttacaggaaaatacattaggttttgggtacaacatagatcatattgttattcagttttcattctgttcttaatggattacaaaaatatgttcagtttagcaaatttttctttaaaaatgtggaatcatgcaaaactcatcaacaaagttgtaaatttacaagtattacttctatgatacaaagtagagtctactgactatttagaagtagccactgcattcatttaaactgagattctagcacttcatgcaattctgttaaaattcatagttgttttggccagccagttctctagactgaggcccatacttggacttcatcacaaatcattcataacttcagcagaacaagacaacaacacagaatagatctagttcaccttctaaattttccttttattttttggtaagtgaataatggaaaaattataggtttagtgactgattattaacaaagaacataaataaatgcaacatatgtagttttattaatttcatcagttttgactattcagagtgagtgtttctattcactttccaattaactcccagctttttcctaagaatgatatttcgggtagtgatttttctttttttttttttacttttcagagccctgaaaaaatagccattaacagttactttaactatcagtacaatgtataataaactagtcttattgaaatgcattagtttaaaacaatactgaaggagcaaaaatgtctatatttaaaacctcactccagataaacagacttctgttgtaataaaagttaagctagcttattttatgtttaaaaatatggattaaatcatgaacaggaaggaagtcacatatttgaaaatgaaatatacaaatgatgtgcttttttaagtggtagcaggaagaatatgccaaaaagttgtgtttaacccatttctcatgatacacttagaaaagttatttaactcacaaataaatgctgataatttgtttcaaaagcattttatgcatgacttgaagacactagggcttgtcaatatatattaattgtatagcaagttataaaatgaagcttcattgaattctattaggtcacatcaaaatacactcctaccagataaattcttccatttcgttttgtttctatggcatttgggaagctcagctgtgctcaagaaactctgttcctgtaaacaggttagatattaatgtcttctttattagtcttcaagagaagtaaatctgagaccttgcctactcagttaaaaaactacgaatcaaatcaaacaatttattcacaattgaccatttcggggaaaatcaaaccaagcaaaaggatcatttgaaatcaaataactaaacttgcaaactcagagtagaaatagcttgagttgaactcagccttaaaaatatttattttacttttttgttatgtacttgtatttgaccaagctaacctgataccatccttatatagttctgagcaaactggtatagatatccatttacttttttcagattttatcgtaatcatattgttttcggaatcctttaaaattatataaaaagcagcaacactttaattttgctgactttctcacttattaataagatccaacttatataatcagctgtctataccagtggttgacagaagtatggcattttcttcaataaagcaagaattatactggatggggaaaagttgaaagcttttcctctaagatctggcacaagacgaggatactcactgtctccacttctattcaacacagtcctggaagtaattaggcaagaagaataaacaaaaggcatccaaataggaaaaaaagaagttaagttatccctgtgtgccgatgacataatgttatagaacccctatttttatttttaaaaatgttatttgtatatatttaaggaatacaagtgtaattttattttagggcattcatcacctgaataatatgcattgtacacattaagtaatttctcatcatacaaccccctcccatgcctccacccttctgattccccattgtcaatcattccacactctactttcaaatgtacacattattttgctcccacatgtaagtgagaacatgcagtatttgtctttcagtgtctgaattgtttcacttaagataatggcctccggttccatccatgttgttgcaaaagacatgattttattccttttgtggctaaataatgttttattgtgtatatataccacattttcctcatccaatcaacttaagtaaattctatatatttgctattgtgaatagtgctgcagtaaacatatgagtgaggtatctttttaatataattatttcttttcatttgggtagatacccagttgtgagaatactatatcaaatggtagctctatttttaattcttagagaaatctccattctatttttcatagatgtactaatttacattgtcaccaaccgtatttaagcattgtcttttctccatatccttgccaacatgtggagatttttttgtttatttgttttttaataatagccattttgactggtgtaaaaaattccaccaaaaactgttagaaataataaacaaattcagtaaaattgcaggatacaaaatcaacatatcagtagcattcccatagcaatctatctgaaaaagaaatccagacctgaaactataaaaattctagaagataacattggaaaaacccttctagacattggcttaggcaaggatttcatgaccaagaacccaaaagcaaatgcagtaaaaacaaagataaatagctggggcctaatgaaactaaagagcttttgcagggcaaaaggaacagtcagcagagtaaacaaacagacaacacacagagcggtagaaaatcttcacaatctatacatctgacagaggactaatatccagaatctacaatgaacacaaacaaatcagtaagaaggaaacaaacaatcccatcaaaaagtgttctaaggatatgaatagacaattccctaaagaagatctacagatggccaacaaacatatgaaaaaatgctcaacatcactaatgatcagggaaatgcaaatcaaaaccacgatgtgataccaccttactcctgcaagaatggccataatcaaaaaatcaaaaaacggtagatgttggcatggatgtggtgatcagggaacacttctacactgctggtggggatgtagactagtatacaaccgctatggaaaacagtgtggagattccttaaataactaaaagtagaactaccatttgattcagcaatcccactaccagatatctacccagacaaaaataagttattatatgtaaaagatacttgcacacacaagtttacagcaacacaaagcgcaattgcaaaatcgtggaaccaacccaaaggcccatcaatcaacgagtggataaagagaaactgtggtataactgtggccacaaaaaggaagaaattaacagcatttgcagtgacctggatgagattggagactattattctaagtgaagtaactcaggaatggaaaaccaaacatcgtgtgttctcactgatatgtaggagataagctataagaacacaaaggcataagaataatacaatggactttggggacttggggagaagagttgggggaggcaagggataaaagactacaaatacggtgctgtgtatactgcttgggtgatgggtgcaccaaaatctcacaaatcaccactaaagaacttagtcatgcaatcaaataccacctgtaccccaataacttagggaaaataaaaaataaatttttaaaaaatcccatttacaatagctacaaaaaatacttaggaactggccgggcacggtggctcacgcctgtaatcccatcactttgggaggccgaggttggcggatcacctgaggtcaggagtttgaaaccagactgaccaacgtggtgaagccctgtctctactaaaaatacaaaaattagcctaatgtggaggcacacacctgtaatcccagctacctgggtggccgaggcatgagaatcgctggaatccaggaggcagaggttgcagtgagcagagatcatgacactgcactccagactgggcgacagagcaagactctgtcctctgtccacccgcccccacaaaaaaaggaataaatttaaccaaagaagtgaaagacctggaaactgtaagacattgatgaaagcaattgaagaagccacaaataaatggaaaggtattctgtgttcatgtattggaagaattaatattgttaaaattcctacactacccaaagctttctacagtcaatgcaatctttatcaaaacaccagtgacattttttacagaaattggaaccacaaaagagcttgaagacccaaaataatgttgagcaaaaagaacaaaactggtgtcatcacactacttgacaccaaaatatactacaaagctatggtaaccaaaacagatggtgctggcataaaaacagacacatagaccaatggaataaaacagaggccagaaataaatccacagaattatagccagctgattttcaacaatggtaccaggtatatccaatgcgaaaagaacaatcttctcaataaatggtgctggaaaaaatagatatccacatgcagaaaaaattagacccttatatcagaccatgtacaaaaattaactcataatggattaaaggcataaacgtaagacctgaaactataagactaccagaaggaaacataagggaagtctccatgactatgatctgggcaaaaattttctggatatgacctcaaaagcacaggaaacaaaaccaaatatagacaaatgggattacatcaaactcaaaaagttctgcacagtaaaggaaagaatcaacagagtgaagagaaaacctacagaatgggatgaaatatttgtacaccatacatcttataaggggttagtagccaaaatagatcagtaactcaaacaaataaatagcaagaaaacaaataacccaattaaaaatgagcaaaagatctgagcaggcatttctcaagagaagacattcacatagccaacaggaatacgaaaacatgttcagcatcattaaacatcaggtaaatgtaaataaatccacagtgagatatcaactcaaacctgttagaatgacatcaagaaggcaaaagataacaagtgttcctgagaaggtagagaaaagggaacccttgcacaccgttggtgggaatgtgaattaatataaccattattgaaaacagtaggggctttctcaaaaaaattaaaactagaactaacatatgatccagcagtcccactactggctatataccgaaaggaaatgaaatcaacacgttgaagagatatctgcacacccaagtttattgcagcacattcacaattgctgagatatggaatcaacctaagggtccatcaactggtgaatgaataaaagaaaaaatgtggtatacgtacacaatagaatactgttcatccatgaagagaatgaaacctgccatttgcagcaacatgaatgaacctggaggatattaagttaaataagccaggcagagaaagaaaaaataccacgttatcttactttatgcggaatctgaaaaggttgattttaaagtagagaataaaatgttggttaccagaaggtgaggtagttaagagagagggaggattatgaagataacggttaaataatacatatttacagttagatatgagaaataaaatcaagagatctattgtacaatatggtgactatagttaatgatgatacggattgagtattccttatccaaaatgcttgggacctgaagtgtttcagatttgggattttatggaatgcttacatatacataataaggtatcttgggcatgggacccaagactaaacacaaattcacttatgttttcctgcactttatacacgtaactttgaggtaattttatacagtatttttagcagttttgtgcttgaaaaaaagtttgcattaaatacttatatgtccaattttccacgtatgacatcatttcagtgctcaaaaagtttcagattttggagcatttcagagtgtgtatttttggattagggatgctcaacctaatttttttcaaatgaaaaatactaagagagtggatgttaaatgataacatgtgagggaatgcatttgttaattagctagatttaaccatatcacaatgtatatgtacttcaaaccatcatgttgaacacaataaatacatacaattctctatgttcatttaaaaaataagcttgaaaacaagaattttacaagtttgattttgattctggatttttttaacttagatgcagacatattatctgatcagggcgaacagaatttagcaaatcattataaaatctttttgaaagtaataaaggaataagtaaaggtattgccctccttttttttccttaggaaatgtttagattggtccttagctttgtttcttgttacacctgtagaatatagctgttgcatacataactgtgtctaaataatctggggttcttgttaaattttagagtctgtttcagtaggtttggaatgtgcctgacattcgacatttttttttttttttttttttttttttggagacagagtcttgctctgtcacccaggctggagttcagtggtggctggagtgcagtggtgggatctcggctcactgcaacctccacctccggggttcaagtgattctcctgcctcagcccccagagtagctgggattacaggcgcccaccaccacacccagctaatttttgtatttttagtagagacggtgtttcaccatgttggccaggctggtctcgaactcctgacctcaagtgatctaaccccctcagcctcccaaagttctgggattacaagtgtgagccaccacacccggccagtattcaacatcttacttaacaagctcatatataacggcgatgctgttaattggtaagtagcaagggtgcatgcaggcaaagttttctcagtattgatggaagccctcacttaaacctagatagcatttaataatttgggttattggtgtcctatcctttacttagcagatttttaacatgtcatctggtaaccatggtaaagattatgatactaaaagcatatgttttagggtttaacgtcacaggactttaaaatctcggttatagctttggacaaaaaacttactaaatctcagttttcttatctgcaaaatgtgaataattctacttacacaatactgtgttaatggtttattcaatcacaaaaagcatctaaaatgccccacaattatcatgtgaatttagaaatactagattccttctacacatctacacacagacacacacattaacacacacacacatacacacacaaacaggggggagagagggtgctgtataaggaatccacaagatatgcaaaatgaatctggtatttctaaatatgcatgatatttgtggggcagtttagatgcttcttgtgttttaataaaccatcaacccagtattatgtaggtattatcacttgtgtgtgtgtgaatattcagacacatcttttttcaacatcttcaatgctggagcattgtgtgagctagaacccagctaagagagggaggtcttcaaagttgtaaaacatatgtgctcaagtgagtacaggcatcaaaatgaattcaagagtaccctttaaaatgctgcatgtcatatacctggttatggcttttgggaaaaattctaatttagatccctttccaagtggcacaccatagtgctttgcaaatgatagactcaagaaggaataaatgtattccggctgaaagttttgtcatgggacaattttatgttacataaatggaaattcatttggaagtgacagggaggttaattttaaatcaattcaaaagctatgaatcccttttggcaactattatgtttagtttaaaagaactctgtaggcttattatagataccatgttaagcttttgttgtgcacgtatatgggtgtgtagttcacattctcagtttttattactaaatttttcaatacaaaaattaattcattttaattgacaatcaagtacaagatatatcaaaatcgagcaatacatattttcattttgtatgaaatgtgatgtatatcgtgaaaaaattttaaatgagaacagtaaggttttctatatttttaatatatccgtgcccacttcacaaatagaaatgaaatgccataatcttcatgtatgagaaatattaagttcattcctatattcagttgctattgcccagtggtatgaaagtcctacctcaaaaaggtgtagccaaagaaagataactggcggggcactgtggctcgtgcctgtaatcccagcattttgggaagccaaggtgagtggatcacttgaggtcaggagttcaagtccagcctgaccaacatggtgaaactctgtctctactaaaaaaatacaaaattagccgggcgtggtggcacacgcctgtaatctcagctacttgggaggctgaggcagaagaatcgcttgaacctggaaggcacaggttgcagtgagccgagatcgcgccattgtactccagcctgggcaacaagagtgaaactccatttcaaaaaaaaaagagagaaagaaaaagaaagagggagggagggagggaaggaagggaggaagggagggaaggagggaggaaggggagggagggagggaggaaaccaatggcgtgcgttttatattatttggaaaccttatatttgactcctctaaaattcagaaatggttttatattgtacaaccgtttccctcaaatatttggtaatggggctgacatagtctatccttacttcaaagtagtctgggtttttgctcgctggatgcatgaacatgttgagatatttaatcactacttcttgtgtcacacttccctctgtcacagttggatggggaatgagctgataaaatatacataattaatagataaggtacattgaataatattacaaatacatgtaactggaagaacaataacactaccacccggtccttccccactagcctcaccatttgggagtttttgctaggagagaaaagtggttaatcctcactagcttctcacctcagagattacagatcattctgccctggtgtttgataaggcctccaaaataaagcaaaaagcttctgccagctttttgtgtaggcaaagtgtagtcatctttgtggtaggtggttctgtaaaggacctgctatttacgcctctgttccccaccacaccccacacccaggaaacaacttgaaagaggaaggagagtccggacgcggtggctcacacctgtaatcccagaagtttgggaggccaagttgggtgggtcacttgagatcaggagttcaagaccagcctggccaacatggtgaaaccccatctgtactaaaaatacaacaattagctgggtgtggtggtgcatgcctgtaatcccagctacttgagaggctgaggcaggagaatcactagaacctggaaggctgaggttgcagtgagccgagatcgcgccattgcactccagcctaggtgacaagagggaaactttgtcaaaaaaaaagaaaaaaaaaaaggaaggagaagccaaatattggcactcgttttgcttaatactataacggacaggcgcagtggctcacacctgtaatcccagcactttgggaggccgaggcgggcggatcacgaggtcatgagatcgagaccatcctggctaacaaggtgaaaccccatctctactaaaaatacaaaaaaattagccgggcgtggtggcaggtgcctgtggtcccagctactcaggaggcagaggcaggagaatggcatgaacccgggaggcggagcttgcagtgagccgagatcgcgccactgcactccagcctggacgactgagccagattccgtctcataaaaaaaaaaaaaaataataataataataataatataagttggccagcttggcaagttttgcaaactttggaaaatgtttctcttcctcactatgaattagattaggctgtccttgctaattaatggggacccatgggagatggcgctaatctgggaggagcagattatattctaagggtacaggctcttggatcaggctatctgggattaaatctaccattgactagctgtgtgaccttgagcaaccttgaggttgctaggtgtgtatcacctctgagactcgattgtgacatctataaaatgttgataaaataagtccctaaatgattaaactgttgtgaaaactatattgctgtatgtcattgaatctaagaaataataaattgcaagatagaccattgttgtgtgtaggactaacaaattaaaaaacaggatacccctaaacgctatacactaatgattttaagacatattgattttagaaatgttaaaatgtgaaatgtcatctcagaatcaattaaatacagtagttaattctgatgagttgcttagatcaatacttggcatatagtaaatgatcaatgtttcctattatggggtggaatttccctgaaggaaggcagtcatttctagcttgaaaatggaggccttttagaaaggaagcccatagccttcaataggaaagagtaagaataggaactggtgcgtgctcacaaaaaacgttgtgtaggggttaattttttcctgcttttctgctacacaacacaagaccaagccattgttagtatagagtttggcctttctccatcccttaacgtaattctcttagttacccccaatcccaaccctccagtaaaggccagtattcctacagaactctctgatggagttgtggggactataagggtgagtagtaacaggaggagagcctgttccatgtttggtgtggggctgaagcccatgctgaggggcagcagcacactaggaagagccattgtccagtaaatggacaattgtccagtaaatccatgtggtgacaagcttagcgaacagtggcctgggcgaaagaatcactgagagtggccaggagggatctaaacccagagaagtgattacccaatagacttctgacttaggagtaaatgtgagaagcaaaatctcttttcccagaattttacaaaaaatcgactcttggaatggcagcggtggctaatacttaggtcacgtagatgataaaattataagacaatatacataatctagactgctgttcattgaatcatgtcagtgtgtttgccacatttcttctaaaagaacatttttcatattttatcatttctgcaatcagtagtagtaataataatatctaacacatacaacttagtatgttctgggtggtattctaagtgcattgtcgatattaagtcatttgtaactcagtgagttagcaacagttgttatccctcatttaacaattggggaaactgaggtgtgaaaaattttcttctccaaggtgtcacacattcacaaatacacacagacacacacacacatagacgcacacacaaacacacacacacacccatctattaagtggtagaggttggcagcatgatcctaaccgttgcatgctcatactattttacaagaccatatgatctaaaatctattggtagcttagaatttatgtaccgctaaatatgtacatctattgtgtactcacaaaaattaaaaataaaaaaataatttaggatatctgttatggtggttaaattgtgcctgcagtgcaattccaatctaccttcctgcgtcctgggaactctgaggaccggtatagagcaatgacaggaagcaagggctctggcttcatatctgcattggaatccaagctctgacacaagctaagcaagcttgagaaactttttaaaagttaaacattttattttcaaagagttgtagagttaagaacagttgtaaaaaataatataaaagatcctatgtgaaatatcctgtgtggcttttgctcggttatccccaattgtaatatcttgcaaattatattcaaacattataatgaggattttgttacaattaacctctctaattcagattttcccagttttacctatactcatgtgtgtgtatatatttagttaaatgcaatttttacacatgtagattagtgcgtccaccacgacagtcaaaatacggatgttacatgaccacaaagatctctcctgttgacctttaataaaatcatcaagcttcctcttgtcaccctgtcccatgcctaacatgtggcaaccattaatctgttcttcatgtctataattttgtcatttcaagaatattatgcaaatagaattgtatggtatttaatcctttcgaactagcttttttcagccagcataattgcttaatgatccatctaaattgttgcatattgcaatagtttgttactttttattactaatatatgttgctgatttatttatggttgtggacatcctacagtttcaccattcactgactgagagatattgttgtttacagtgtggggctgttactaataaaattgctgtgaaccctaatgtacaggatttgtgtgaacataagtcttcatttctctgggataaatgcccaggagtgcactttttggactataatggtagtctcatatgtcgtattgatgttgtcgtttatttttaaatttctttttcattgacaattaatatttgtttgtatttataggttacaatatggtgctttgatatatgcttacaatgcagagtgattaaatcaggttaatgaatctgttacctcatattttttttgtggtgaaaatattaaaatccactatttcagcaattttgaaatatatgatgcattatgatatattatagtcaccatcatgtacaatagatcactaaagcttcttcctcctacctaactaaaaattcgtaccctttgatcaacatctttcttttcccggtaggacccttccgccatttctgtggtaatcttcattctaatctgtatttctatgagttcaacttttttagattctgtccatcatcagatgaataaataattaaaatgcagcctccacctgctgggtttaagcgattctcatgcctcagtctcttgagtagctgggactgcaggcgcccgccaccatgctcggctaattttttgtatttttagtagagaaggggtttcaacatgttgaccatgctggtctcaaactcctgacctcaagtgatctgcccctctcggcctcccaaagtgctaggattacaggtgtgagactccgcacctggctcctttagcttttaagaagagaaagaattgaaattatgattacaaccaagtgaagttgaacttgaactcctaattagaggatggttctgatgttaatttacgtaaaggaattgtgatttttgtttttctgctcccactccaatccgttttttcccacacagaatattcccaactcttccttcttgaacctttgtaacattactggcattcgtttctcttatccataagctctaatcatccaatgtttcttcttgctgttattatattgaacaaatatttattagatcaatcaggaataggaagaatagataattttgttttactttcattttttccttctctaatgtacttcctttctttatgtagatctaagtttctgacttacatcattttctttttctctgaagtccttcttttgacatttcttgcaaggcagatctactggcagcaaattccctcagcgtgtttgtctgataaagtattcatttctcttttacttttgaaggataatttcaccaatacagcattttaggttggtggatttattttttctctctaaattttaaatatttcagtacactcttttcttgctggcttggcccaatccattttatgctcttttttgttctgctctgtcactgtgaagctgacccctataaattgcatttccttagctcccttgccgagtagtctcctgttggttttggccaatggaaggcataaacataagacagaaaggcagaaagagagcagatctgggacattccttttacattgacctccactctctttgtgccttatttcccaccatggcagcttatatctctaactatcctgttaagaatctcctctatggctctatctcttactggatttagaaaatcctacttccttcacttgactcttcaggcatggtaaggctgggaaaggtatatcacaattgcctactggaggttgtctctaggtgcctcgatagccccttttggtttctttaagcccattcacacctctgaaagtagttcctttgtactgttttattgaaccatccatgttgaattctatttcttgccagggacatggctgataaagggagataagaaaaatcagtaacttctccctttgaagtaacaaagtataagatgaaagtaaatgaaactcatagttactttaagaaaatgcgtttgtgtatatataaacaatttctacttttcatgactctatctggtggtttttagtataaaatactcactagaacgtgagattaaagtttgccactccatactgatttgcatatggactgttcgctcaagaagtaagggttgaagaaattggaacgacttatcatttaaatcaggaatcatatgacaattcaactggtgacaatgtgccctactttctaagagcccaagttgtacatatgattgcttgtgtatgtatgtgtaagtcactccacgcacatatgcacgtcacccttgagttctgagtttacaaaactaaactaaattcagttactaaaaatatcaaatttgtgtaattttcatgtatttctatgcaagcacatcattactgaaaggccctattatactgttgcaaaatactcatgaagtaccaaggtgcctgattccaactgttatttatttttttttttttttggctattatgttcctaacatagcacataaactagctcattttctcatggtacttaactaaggatacttttttaaaatctagagtattacagggtctttgcatacctacctcttaaactgatttgttttggattctggaaaacttagcacgttggttaagtggctgtgaagaaattttgatgtatacgtccacctcacatagacctaatagctatgtgtttggctagtattttgtggaaacaaataattaagagcaagaaaagttggatttccttaagaacactgaatcgcatagagattgggtaattactggagacaaaaaggcctgtcaataaaggtcagatatatgcaactccctccttttgctgaaaatctattattccatgttgaattagatattaaaagaatattatactttccaataattatattgttataatgcaggggatatatttctcaccaatgactctacatccacaatgtatgatgaaataaaatatatatttatttttaaaaatgcctttagggttttaagatacttaagaattcatttcttgttcacttttaaatttagtgctcttagttctaagagtttgtcatctgttttatgatacaggttaatactgcaatataagcaaggaccagtcttcattttacaacatgtatcataaaactgtaggctaaagaaaagtaattaaaaaacactctgatgcatgactttaatgtaattaaaatatattttgcattcatgaaaaattacaggtctctatcaatccctctataaacaattataatcttattacttaaaattatttcaacatcatacacatatggtgtatatttagctatagtcgtttaggtttttaaaatctgctttcttttctaaatcataattttagaccttttgctatgttcgcaatctttgtgtaatcacatgcatagcagacaatagcacattgtaagtatattagaaatatgaaaacacagtctaatctcaatgcaaaacactgttgaaaaacacagcatgataaaaaattaacttataaatggagagatatactctgctaatggattggaatactcaacatggtaaagatgtcaattatctccaaattaatctatagttttaatgccatttctactaaaataccagcaaggtctttttagtagacttggatcagcttattctaaatttatacggaaaagtacaagcctgataatagctaatacaatcttgacaaagaagaataaagtggaaagaatcactccactaaatattaaggcttattatgtagctacagtaatcaagacagtgtggaattgggggagagatagacgcatagttcaatgcaatagaatagagattccagaaatagacccgcacaaatatgtgcaaactcattttttaaaaagttgtgaaagcaattccaaggaggaattttaacagcctttccatttctatagccttttcaacaaatagtgtgcgttttttctaagtgagtggtgtttgagcaagtagacatctaaaggcaaaacaaacaaagcccacccataaatatataagtaaataaatagagcctcaacttaagtcttatgcaaaattatctcaaatgtcaaatataaaacataaaactacaaatattttagaaaaacatatgggagaaaattttgtgactgaggcaaagactttttacactttacacaaatagcacaatccataaaaaagaaaaactgataaattggacttcgttaaaattaaaacttttgatctgaaaaggatcctcttaagaagtgaaatacaaggtacagaatgggagaaaatatttgcatatcagttgcaaaaacagggactatatacgaagaacttagaaaactcaaaagcaaaaatccaaaaataaattaattaggaaatgagccaaaggcacgaagagacattttactgaatagtatatataaatgacaaacatatggaaaagatattaaatatcactagacatcaagcaaatataaattgaaaccacagtgagataaaactacacatttttcagagtgtctgaaataaaaaatagtgacactaccaccaaataactagcaaaaatgtggagaaatgggatcactcgtacattactgaaaagaatatcagtctggaaaatagtttggcagtttgttaaaaataaacaaacactgtgtatgtttaccactccagcctgggcaacagagtgagaccctgtctcaaaaaaaaaaaaagctgaagaaaaatttttttaaatggggaatataggtggaagtgagagcctgatagcctaatatactttatcttttctaatgtatttaactgctgctcttatcattgcttctatttaaaaatgtattatatttttgctaaccaaccttctaggagccaattgtactctcagatttccccgttttcatactgaggttttatcgaagtagcccttctccaagtccctcccctttttattttaaatatagagattttaaactatttctaatcttactctcttctccaagttcctgaaggtattacctcagaatatgaaaacccttaaatgtacctcatttgctaacgtggagagagagacatgtaccttggaagataatttgtgatggaaaaagcatatgcctacacacacacacacacacacacacacacacacacttaaacttgggttcaataacatattaaacttgggttcaataacatcatacttctcaatattccaaataaagttaactctaaagattcaccataagattttcaatattttaaaaatgtttaaggaaatataaatgctttaggttgtttaggttgtttagacatctattaaacccagaatatactttaagcactaatctttaatatactatagattaaaagctatctttcaaataaccagacttcacaatgtttaaacattttataaaactgaacagaattttgagacataaaccaatataaaactttttttatcctcctctaaattcaatccatttgtgaaacctcatttaaattcgaatcaaatattttctctgatttccattaacaggctctgactctcaggcttcagtgagtaagtatattcattgtggggctcagaaaattttgaaccaaattataaatggtgtttatttgtgttttctttccatttctttttaaggcattctgtagtgaggtattcaaaacaggatgccactcaaagactctctctctctctctctctctctttaaaaactattagagaaaatagcatgtgcagcttcatctgctacataaatcctctcaaagcttctctcctttccagatgatttgagttgtcaggaagcaaatgaagcttaagcttttgggcccctttatttcatagaagtcttcaaaaatatgtgcagaactttcatataatcacgtgctcgaaaaatatgcacaactaagaatagcctcgagctttaggcaccgcaatcgttggatcttctgttcttatcaattcttaccaattgtttcttaggatgacacattaaaccttcagaaaaaccttatcaggatgaaaacttagccttgccatggaaaaaaatggtggttttaagaacagagtaaaaaaataattctaacagggaggggatttttttcttttgcttttttaaagaaagaaattaggaaaggattttaatttgagcctacaagtttgctgaagttgcactctaaaatgtcatccacatagatttatattgttttctttactctttcttgtgtagtaataacttggtctaggctttcaataaataaacttatgaaacagttttgagtattaacaataacacaatggcactgagagcctgtttttacaagactctaaatattttatttaaacgatacccagaattctgatttgcatatttaaaattttcctgaattagataattcttttaagtgtgttacgttatataatctagttgcagtatccttttaacaaaaaaaagcaagtgcaacagtgttaaacatgacattgatgccacctaatctccatcaggcttcacaatgtagttttatcttatatttatttgtatgcacgaatgtcagtgtcgtatggcaggagtctgtaaactttggctcataggctaaacccagcccactgtcttttaaaaaaaaaagatagatagataactgtaaattcacatgcagttgtaagaaataatacagaaagatcctgtgtgccattttacccagtccctccttaaggtaaagtcacagaactatagaacaatattacaacaagatattgacatcagcacagataaaatacaggatatttccatcaccacaaggatcactcatgttgccctttcatggtcagacccacttttttcctgccctcaggcactccttaatctctagcaactactaatatgatctctatttgtataattttatcatctcaaaagtgttatgtaaatgaaaccctgtattatgtagctatttaggactagccttgttcactcagcataattctctggagattcttccagatttgtaatgtgcatcaacaatgtgttcctttgtactgctgagtagtattccatggtatgaatatgccagtttgattaaccatttgcctgttgaaggacatctgggttgtttccagtttctgcctattacaaatacagctgctatgaagactcatgtacagtttttttatgagcaaattttcatttatctgggattaatgccatggaatgaaatttctgggctgtaggttagttgtatgtttagttttttacaatgcaccaaacttttacagagtacctttaccatctcatgtttccaccaacaatgtgtaagtgatctcatttctctgcattcttgccagtgtttgatgttgtcactattttttaacttagccattctaatatgcacagagttatatcgtattgaggttttaattcgaatttccctaagagccaatgatgctgaacatcttttcacaagcttatccgccatctatgtgttgtctttggtgaaatgtctccatgtcttttgcccatttttctaatggatttttttgtgtctattttgtttttacttttgggttacatgaattcttcatttagtctagatactagtgcatggtcagatatatggtttgcaggtatttttctcgatgtgcagcctgtctcttcatcctcttggcagcatctttctcagagcaaaattttaaaattttgtatgtcaaatttatcaaattgtgtcttttaaggcacacgattttaacgtcaaatctaagaactcctcctagcctttcatcctgaagactctcctgtatgtttttgtaaaatatttattattttgtgtttcacatttaaattcatcatctatttgcattttattttgcataaggtgtaaagttatgtcaaggttctttttcttcttttttctttccattatttttgtccacttgttctaagacccatgtgttgaaaagactatctttgctccactgaattattttgcactgtgtcaaaatcagttgagcaatttgtgtgggtctatttctgaagtctctattctgttccattaatctgcgtgtctatcccaacaccaacaccacactatcttgattactgtagctatttaataagtcttcagtctggtagacttattcctcttacttcattcttccttttcaacattgttttagctattctaaatccattgccttttcacataaattttagagtgccttttcacataaatttttcctacacctaaattccaaaaatattgctgagattttgataaaaattgtgtaaactgtgtaacagtttgggtaaaattgacattactgtgttgaatctctcaatccacgagcacaatatatttcttcattaatttagatgttctatgatttacttctaaaacttttttttgctttcaccatgtaagtacatggcttgttagatttatatttaatttttgtgacatagtaaaatatactatattttaaatttccatgtccatatgttcattattaattcacagaatgcaagtgattgttaatagactttatttttggagaacctttaggttcacagcaaaattgaaagacagagatttcccatctacccattgtgcccgcacgagcatggcctctgtcattattaataactctcaccagagtggtacattcgttacaataaatgaacctacgtcaacacatcattataactcagatccataggttccattagagtttactcttgttgttgtgttttctgtgtgtttggacaaatttatagtgatgtgtatctactatgataatatcatacagagtagtttcactgacctaaaatatttgtgctctgcctagtcatgcctccctgccaactaacccctggcaaccactgatatttttactatcttcataattttacctttcctggatgtcatatagttggaatcctacagtatatagaagcattttcagattggcttccttcagttagaaacaggcatttaagtttccttagtgtattttcatgtcttgatagctcatttctttttagcatctatagtctgaatgtaccagtttatttatccattcacctactgaagaacatcttgttgtttccaagttcaggcaattatgaataaagctgctataaacatccatctgcaggtttttgtgcggacataagttttcagcttatttgggtaaataccaaagagtctaattacttgatcatatagcaagagtatgtttagttttgtaaaaaatccttaaactgattttcagtggttgtacaagtttacattctcacaagcaatgaacaagagttcctattactccatatcctcaccagcattgggtggtgtcactgttctgagtgttgaccattctaagaggtatgtagtagcatcacattgttgttttaatttgcaatttcctgatgacatatgatgtgaagcgtcttttcatacgcctgttttccatctgtatatcttctttggtgagttatctgttaaggtgttttgcccatttttaaaatagagttgtttgttttcttattgttgatttttaacagttctttgtatattttggataacagtccattacctgatatgtcttttgcaaatattctctcctattctgtggcttgtctttacattcttttgacaatgtcttttgcagcatagaatttttcaatattaatgaagtcctgcttatcaattatttcttgcataggtcatgtctttggtgttatatctaaaaagtcatcaccagacccatatagattttctcctatgttatcttctgtgggctttatagttttgcattttacatttaagtttctgatccattttgagttaatgtttgtgaaaggtgtttgcatgtggatgcccagttgttccagcaccatttattgaaaaggttgtctttgctccgttatcaaacatcagtcagttgactatatttatgtgggtttattcctgggctctctattctgttccattgatctcttcttttgccaataagacactgtcttgattaccgaagtcttgaagtagagcagtctcaatcttctgactttgtgcttgtccttcaatattgtttttgtttgtttgtttgtttgtttgagatggagtctccctctctctgtcacccaggctggagtgcaatggcatgatctcggctcactgcaatctccgcctcctgggttcaagcgattctttcatttcagcctctcaagtagctgggattacaggcgtgtgccaccactcccagctaatttttgttgtttttagtacagacggggcttcatgatgttggccaggctggtctcatactcctgacctcaagtgatctgcccaccttggcctcccaaagtgctgggattacaggtgtgagccaccacgcccagcccttcaatgttgttttggctattcaaggtttcttgcctttccatatcatttttagaatctctttgttaatatctgcaaagtaactactgagattttgattgggattacattgagtctatagatcaatttgagaataactgacataataaaaatattgagccttcccatccatgaatatggattatcttctatgatttctttcatcagagggttgcagttttcctcatatagatatggtatgtattttgctagttttagatctaagaatttcatttgtgggaggtgctaatgtaaatggttacaatcaatttttgtatatttatcttgcatcctgctaccttgatgaattcacttatcaataatttctaggagattatttatagatagcttgaaaattttattttcatgccatctacatataagggacaattttatgtcttcctttcccatctgtatggattgatttaattgtcttgcctcattgcactggctagaacttgtagcagtacgtgaataagagtggtgagcgtgtgcattcacgccttgttcacaatattaaggggaaagcatttaatacttcactattaagtatgaagttagctgtaggtttatgtagatgttgtttattaagttgaggaaattctcctttagtcctatttttcagacaggttgtttcaagattagatatatcagtttgtcaaatgcttttagtacatttactgataacatcgtgtgatttttcctctatgacctgttaatatggtagattgtagtgactaattttcaaatatcaagccagatttacatcctggaaataaaccccaagtgatccattagtacattgctgaattttatgtgctgaaattgtattaataaattttccattaatatttgtaaggaatatggatttatagttttcttcttttgtactgtttttctggtttgggtatcaggctattgctggactcaacacatatactcagaattgttttcttcccttccatgttctggaaaagaatgtgtagaattggtgttaattcttcacaagattggcatacttttccaatgcagttatagaagtttgcttttgtagaagtttttaaattatgagttatatttccttaacagttatactcattatctagtatatccaaattactattaaatagccaaagtctaggccattcaaattatccattttatattcattgatttacagtagtttgtgccttttgaagaatcaatctatttcatctaaattattaaatacttatgtgaagaattgttcatagtaaacccttactgtctttttttttctttgtattttccaggcctgtagtaatattccctacttcatttctgatacgggtaacttgtgtcctctcaattttttctttgtcacttttagcacattgtcaattttattgaccgttttgaaaaaatagctctttgttaatgaatcttctttactgtttttctgtttttattttgattagtttttactctttattattttcttcttgagatgagaactttgattattgatctgagacttttcatcttgtctagtgtatgcgtttgggagcagctttttaaaacgcaatgcttaatttaacctaaatgacaatattttatagtaggcagtgcatacggtgttatctttaaaacctggtcttgctattaggtacctctctgagacgaaagtcttcaagcttattgaagtttatcaattagcaggtcgattaaaatgtcaacttttcttttaatatacccaaggtataatctatttgagggcagggacctgaagttgttagctcatatctttaatgcagaaaatctggccctaataaatgtttcataaataaatacacatttattccacggcccagttccattgttttaaatgagaatttgtcactatggtcatcccatagtaccaaggttcataatttcttttagcatacactctcaaagagatttggtttgctactctcaaacattcaaagtttattttaaattttatgatgatctggatcataaatttctttatttccctctcttgcctgtttccttttttccaactgatatcactaaactcctattacacccaatgtgcttttgagagctaaagttatcaacataatataaatagcaattaattcttaatatcaagaagtttacagctgagtagtaaagatgcattcatattgttagacccatctatgagtgggagtgaggagaagctaaaaaaaataatcttcataaagtaaatttaaacaaagcccagaagaatgagggagcatataatacacaaaggatataatacaaagaaattgcaagtggagacaattttattcacacaacaaaatgacaagcaatagtgataaagcaactaaaaaggaagacacaactgttttgatggagcttgccttccatcaggtaagaaacaccttaaacatacacccaatttatttatcacacatgcaaaaagggagtaaagctgcatgctcagaaaacatgtatgatgaattttttaaataatctgagatataatagtaggaaagcacataacataactcaaggaagttcagagatgtagggttgaaaatgaaggcaaaggctacattgcgtaggatctattcatccttgatcatattttctacaaggtatcacactagtactgagtatccatccaagactgaaatggtaggggtgagcctgcttgctaaaaattcttcagttgtattagtggcagtggctccactcctcgctaccacacccattttgcaattctctgccctgttttttgccctggaaagcttgtctcttcatttgtatcaccaacgcctcttgtgcactaacttttaggaaattatgtgacaccagctggacatcagagggcaagggaaaaaaaggtttggatatttgtgttccacttcacatatgcctcactaaggtcctggtagtgactgcccttttctattgctattccaacattattcctttaccttgacatattaggcctggaggtagaaacaaattacctctcttgctgcttgctaggtgactcaccatcccttatttgttctcatcagcctgcctatatgtttgtccatagttctttcaccgaattattatctgttaaatgcttttgaatctgctacctatatttcctaccaggatcttcactaataccccataagagatacaactattaaaacatgttactgattctcagctcactagcatcaatgcatttactatctttgtactcataatacctttcttacattcagaaatctttaaaaatcttcattaatccctgtacatttacctcataaaacagttgggaatcaatccacaaagtgaggagtcattattttcacaacacaggcaaattagttttgagttttgcttatatttggtaagcaaatgttttctttcttgactctatagatagtactgatatgtagtaccaagtcctgaaatcacatcgttatgtgaatgccatgggcttcattgtctatggaaatgtgagttaaagctctttttttttttttgtccagtggaaaaaaaaatctgaacatttaaaaatgaactcacaaggttccagatatctacttactaattttaaagggaattaagatggtgtcaagtaaaatttatttacagaacacacacacacacacacacacacacacacacacacacacacacacacaataatctctaaagtatcaaccatagatggagtggggaaccaggaccttcactcccacctggcaataaggcagcacacttctacctctatcttccaccagaacagtcagaaggggacgagctaaaatagatttaaataagatccagagtctgataatgtaatatcccaaatgccaaaaaagaaaatctcaactggaatgcaaaaagatagtagtcacttatactgacatgacaaagatgacagaattatctagcaaggatattaaagtagccatcccgaaaattgttgagtaagctttttaaaacattttgcaacaaataaaaaatgggaaaagtcagaaagaaatagaagacatagaacgacatgacattttagaactaaaaatatcgtaatcaaaaaaaagttcaataaatggtctcaacagtagaatggaggtgaggagacaggggaaatctgtgtgcagaaagataggacaatagaaattacacagtcgtaacaagaaggaaaaaaacgatttttaaaatgaaaatattctcagttgtcctatgggattataataaaagatctacggtttatgccatcagagtttcaaaaagggagggtgttgttgaacaagtactcaagcacataatgattgaaaaataccaaattttgtaaaatgcaaaaccctacagattcaaggagctgagtatacaggataaacccaaagaaactcatgcttagacgcatcatagtcaaatgtctgaaaactagttatattttttttttaaaaaaagtcttaaaaacagtgaaagagaaaaagacactttatctataggcaaaaaagttcaaatggcagaggatttcttatgtgaaaccatgaaagcccgaaggaagaagtatgacatttttcaagtgatgaaaggagagaactgtcaacttccagaaaatagaagaggaggcaacacttccaaatgtactttatgaggaagaagtattttgataataaaaccaggtaagcacagtagaagagtcaacaaattacagaccaataaaactcatggatatagagacaaaaagccttaacaaatttttacacattatattaagaagctaaagaagaataatcacttgatcatatcaattgatggaggggaaaaaacgtttgacaaaattcagtgccccatttatgataaaagctctcagaaaactaacaatggaggagaacgtcctcaacttggaaaagaataactacagaaatcttatagctaacattgtaataataatgaaagaatttacacctttcttcctaatattaggattaaggcaaagacggttgctttcagccctactattattcatagtactggaagttctagctagtgtaaaaatgcaagaaaagtggataaaagcgtacaaatcaggaaggaaaagttatactgtctccatttgcagatgttatgatgatctatgtaaaatcccaggtattctacaaagttactcttagaaatgatgagtttgttaaggtcttaggatacaagatcaacttataaaagtcaattgctaatcaatgaatatgaagtttcatttatataagatgaataagttctagagatctgctgtacaacatcgtatctatatgtaacaatacagcattataatttaagaatctgttcgttgggtagatctcatattaaatcttatcacagtaaaatgattattaaaaattaattgtatttttgtatacaagcaattaactactgaaacccaaaatttttcacatagtatcttgcagtcactctgaaacaatgaaatacttatgaatctaataaaacatttaccagatctatatactacaaactaaaaagctaaggaaataatgcaaagacttaaataaacggagatatatactgtattaatggaattggaggatacaacatagtaaatatatcaattcttccaaaactaatctatagtttgaatgcaattcctatcaaaacatcagtgaaacatttttgtctatttggacaccctccaaattgcttgaattctatttgtcttattttttctggtcctagtgcctataaactcactcacaaactagcatattttcccattggacttaactaaagagattttttaaacacctaagaaatatatgccttataatatgggtaacatttcaaccaatatggatcactgtggaaaaaggaagtagaaatgatccataatgattttttccctaatcaataaatttgtgaattttatataagtatattacctaataagcctgtttctcttcaacttatttgtcctgtgaagctgcattaatcataatgcttggaattatattaaataatcaaacaagttgggaaaatgaccctgcacttccaaagtaatataaaataatgcctttagggtttccaattatttaagaattaactccttgttcactttacgtttaccatattcagttctttctaattaatatgccatctatttaataacacaaggatgactggttaatattggaatataatcatgggccagtcttcattttacaacatgtatcatctaagtgtagacaaaaaaaagtaatttaaaaaaatgtgtatgagttcactgtaataaaaattatgctttatatttttgaaaaatgtatgtctaattaattcatctgtaaacaattgtaatttcattaaaattttaacaaaataatttcaactttcattttgaatcgggggtacatgttcaggagtttgttacaagggcatattgtgtgatgtggaggtttggggtactgatgatccagtcacccaggtagtgagcattgtacccagtaggtagtttttcagctcacacccgcttccctccattccccctctagtagtccccagtatctcttgttcccatctttatgtccactgtgtactcagtgttttgctcccatttataagtgagaacatgcggtatttggttttctgttcctgtgttaatttgcataggataatggcctccagctgcattcatcttgctgcaaagtacatgatttcattctttttcatgaccatgcagctaaccaaggaggtgaaagaactatacaaggagaactacaaaacactgctgaaagaaatcagagacaacacaaataaatgcaaaacatttcatgctcttggattggaagaataaatattgttaaaatggccatactgcccaaagcaatttacagattcagtgctaatcttatcaaactaccaacgtcaattttcatttttcattttcattagaaaagactaatccaaatttgtatggaaccaaaagagcccatagagccaaagcaatcttaagctaaaagaataaagcaagaggcatcacactacctgacttcaagctatactataagcctacagtaacccaaacagcatggtactggtacaaaaacagaccatagaccaatggaacagaatagtgaacccagaaacaaagcgacacacctataaccatctgatctttgactaagtcaacaaaaataagcaatggggaaaggacttcctattcaatagatggtgctgggaaaactggctggccacatgcagaagattgaaattggacctctacttttcattatatacaaaaatcaactgacggtgaactaaaggtttaaatataagacctcatactgtaaaaaatcctagaagaaaacctaggaagtacccttttttacattggtcttggcaaagaatttatgactaagtccccaaaagccattgcaacaaaaacaaaaattgacaagtggaacttgactaagccaaagagcttctgcaaagcaaaagaaacatcaacaaagtaaacagacgaagaatgggagaaaatattcacaaaatatgcatctgacaaaggcctagtatccagaatctataagaaacttaaatcaacaaaccaaatacaaatacattcattaaaaatgggcaaagtatatgaacagacacttttttttttttttttgagatagggtcttgctcttagtccaggctgaagtgcagtggcacagtctcggctcactgcaaacttcacctcccctgctcaagcgattctccagcctcagcctcctgagtggctgtgatgacaggcgcctgacatcacggctgtattttttttagagatggggtttcaccatgtcgccctggctggtcttgaactcctgagctcaaagcgatctgcctgcctcaacttctcaaagtaatagaattacaggcatgagctaacacacccggcctgaacagacacttcttgaaagaagacatacaagcggccaacaagcatataacattttttaacaacgtaaacatttttaaatgtgcttctttttacaaactggccgagtgtggtggctcatgcctataatcccagctcctggggaggctgaggcaggaggattacttgaggccagaagttaaagaccagcctgcgcaacataacaagaccctgtctctaaaaaaaatattaaattagctgaatatggtggcattcacctgtagacccagctactcagaagattgaggcaggaggatcacttgagcccaggagtttgagactataacgaggtatgattgtgtcgctacactccagcctggatgacagagcaagcctccatctcttaaatgaaaatttcttaaaaagcaaaaacaaacaggaaaagaacgggttttggaaactctgctgttttcctttttttgtgcaatcacatgcataaccgacagtagtgccattatattagaaatattaatatatctaatcacaacacaaagcactgtgtaaaaaagccgagtatgatgaaataaattaaagataacctaaatattggacatatgtactatgttaatgaattggaggaatcaatgcggtaaaaacatcaattcttccaaaatgtattcataattttaatgcaattcctatcaaaattctacctgaaagatattctgtagatagatctgtagatctatttgtagataaacttattctaaaatttatatggtaaattataaccacactctgggacatgaatctagaggaatgaaaaatgaaaaactacatgattgttttgcagctttatttgtagtgaccaaaccctggaaacaacgaaaatatcccacagtatgtgaataaagtaactatagaacatccatgccatgaactactactcagcaataaaaggaaataagctattgatgacaacttaaatggatctcaagtacagaatgccaaaaaaaaaaaaaaagccaatctcaaaaggttacataccgaatcattgcatttatctaatattcttaaaatgacaaaattacagtgatggagaacaaattgattggtaccaggctttagggatatttagggagggtgactgttgtgactgtaaaggggtagcatgaggcaaatctctgtggtgatgaaacaggtgtttatttgtggaggttgaggttacacaaatcagtgatgaaatagaaatatgtatacatatcaatgtcagtttcctggttttgatactgaattgtagttattgtaggatactgaattgtagttattgtagttaatctttgggagaaactgggtgaagggtacatgggatctctgtatactatccccgcaaattcctgtgaatctataagtatttgaaaataacaagttaaaataaatttttaaaaattctgtgacagttattaaaaatggaaatttgagcaagttcctttattatggggctaataagacctacaagatgtagttattctgaggactaaaggagaaagataagtgattaagggacacaagaaagtactgtggtgacacagtctgaactggagttcaatttgttcggtctaaattttattttacgtgcctttcacttttccagttattgtaagcatatatttgcacctggattataaaatcttaagggaagtatatgcattccacacaatgcagaaatcattataggtgccaaataaattctgattatcaactaaggctgaatggcaattaaatgtatctcagggcattcagatctatcaggatttggtgctttagacattacccaggacacatctttgttacatttagaaccacggttgtttttagaaacatacactttagggtttctcaaagttgaccatgcattagaatcaccggtaaaacacagagtgctgtgtcccaaccccagaatttctgacttttgaggtctcgtgtcaacttgcatttctcagaagttcccacgtgatattgatgttggtttgggaccgacaagttgtattcacgccttggcctaaacaagggtttatgtttgtagaaaactcacagtgcaagatacaaagggcacttatactctgggcaatattgtacctcacagcatagagggacactgatgctaacatgcagacttagagccaaatcagccccaaaacaattttttcattttttctatgttgttttatgaaaattttgcttatatgcatatttagacaaccacactgagaggaaaggaggtgacctagggaaaagaatgttttaaattaaaattaggccttatgttttatctcatacaccttttgctggggaaaatagcaatgttatgacaataatattctaaaacacaaaatgtacaattaactattaaggtaaacatcacagtctgactcaatatttttttaatttttatctattactcattgcagtcgcaagcagttgaatgtttgacatagaaaaatgagtctgtcactttaacaaatggtacaataaaaacactcaaacaaaaattttagtagggattattataactataaaaagaatatctttctttaaaaaatgtttccaatgttttctatcaattttgggctcgcctgttgcataaaagtaataaggaacaagatgaagaagctttctattggcaaagaatgatttacatgctgaatgacataatacaactgtattcacttaatacagaaaacaagcctctattcagaaccattaaatgatcattaactcaatgtctaaaaaaatggtgttttaagaattggcaccagagaaatggaagaaagaataatttgttagtaaagaagttttagcataattcacaactgaaatttaggatttgagaaaaatttctttcctgcattataagagtattctttattttagcaggaaaacatgtcccatgagacctatacacacacacattctgccttcagaattcagctgctgcattctgctgctgcttctcttattcagactgttggcatcatcaatacataacttttgattgaatcccaaggggaaaaaataactttggtagacagtggatacataacaaatgcatggattattctgggcattcctttttatttggtagagtgaaatttttggtgttgttgagaggataaaaaaggcatttaaaagtcaattttgaatccggattttctgctctgttaataaattcacatgaaagttacagaaagtattgttatgcttttgtactgaatagtttttgtgtttagaaggctttaaaagcaagtactatgtccactgtgctattctggtttggatattaatcagaacacagttgagcattgtttgaattcacagagcttgccatgctggaagcacaaccttatatgtagtgaccatggacagtcctattatgggaaaccaacttgagagagaaggcgggtcacttgcttgtgcgcaggtcctggaatttgaaatatccgggggcctctacagaatcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttgtaagtacaaagtaactaaaaatatattttactgtggcataacgtttagtttgtgacaagctcactaattaggtagattgattttaaattatcacagtagtttgcaaagaagcataaatgttatatatactgcatatatatatgtatttattcaggaatatatatttttcattgggaaaacttttcaacagaaatggagtgtaaaagtttttctttgcgatagaactaaacacatgatttcttgattaacaaaccactgcagtaatagaatatgcagaatgtcatttgactataacagatttattttgattgctgtgagatagtttgtatatctgagttattattttgattagttgatacttccgtatttagtaacagttacataaaggttactgacctgacatatattctcaattgaactaactactgtataggaactacatggaggcctaaaagttagaaaaagtttctctgacacatcatggataaaataaagaataaaatgagttgggacggataattgaaggatgtgaaaagtattgataaagatttaattttaatgtttcttactcacatttactatttcaaatgctcttttctgtagcatatcatgataattatttcaaataatgatgtgatctatgctatcaaatgatcagatgatttcttgggtaaacgacatacaaacttgaggaactcctaattatatttagtagtaaagtcaccttgttgtttcatgtctattatgagccagcttttcagttcaattttttagtttgtctttcatatagaaatacaactatttcgtttatttttaagaaagtcatgatgactaatgaaggatttaaaaatggactgtggcacaacagtaaaaataatatatgataaggactgtgtgtcccgaagagatgggagtttatctcttccccacccatctttgacttgtggagtgtagttattctaaaatagatatgagggcaatgcctataattaagaatgaaaaaataaatctctccaaataagtaatgctccacaactactaaaaaaaaaggcagaagttttgccactgggaaaactttgtggaaataagttaacattgtccatgtattgagtcacattaaaagctaccagactttataatacaatatttacttacattgttggcttgcttcataaatttcttttggtggacatcattattacttttagattgaaaaactattatatttactatcattacaaatatatgcatggcatatatctgttgtttgcaatatacacacacatttttattttttgtttttatttctttgatatatgtaacataaataccatcaaaatcactagtgattttatatatatatatattctacataattaacatcatatacaagtatatagagcaattttgaaagaatatatgcaattctgctgaaattaagcaaggtaaatctacactctgctttgtcatagatattcaaataactttcaattcttagaatgcgaagaaaggtaatctttttgggacatgccctgtaggattttttcacgctgcatttaaaaaatcatcaagtaatgcctatgcaacatgacaatgagtttggtaagaaaaaacggagatatactcagggctatattatacattaaattttgctgtttgacaacatactgctacttggatgtttgacatttgaatccagtttgtaaatttgccgtagtttgataaacttacaaaagtacgttttgttgttttttaaccaaaacagttaccctttaaaagagatcactgtattgtcaaacatattgtattgttcacttttagaattactcaaataatgcattgtaaagaattattcaaatagtgtactgcaaatagacatttcatttgaatatatttaaatgatgtaagtcatctgaggtctaataaaatcaccttttagaatttcatctgcagaatcttttaaagacatcttaactacgaaaaagagattgctgatctaaattgatgatatactgttaatacaaagcttttggtgtatcttacatgacataacattatgaaaaatacaatagagtatgtcatatagatgttactctaaactttaaaaaaagactacaaagtgttctatgcataattacattatttaaggggaaaaaggtgttggctgacactattccagctagacagtactgaattgcaaattcatcatttgggcacagatattaatacagcttcctctttattcctatagcattcatttgaaatccctgtactccatgtcatttgctacatatgaaacaaattgtcaagtttttaaccacttgtgtagtttaataaaagagattaaaatcattgtcttggaaacatcaggtgtttttcaaaattctattttattatctttcatcaaaattttatctcaagagtaaaacaaagtcatttcccaaactttccttctccttccaccttctattgtaatattttcctaacttattaaaaatgatttatcatactttttcatcaactctttatttcatcacacatacaagaaacacagtattttggtatgagtatatatatttatatatatgcacatttatatgcattcaaatcacagggtataaagtttcctaagagggtctaattagaaattaacctttctttaaagataattttctgttcatttttctaaattttctattttaaacacacatcattttttaaggaattgacaaatgagactaatgtacattccctgtctgacaacacagaacgaaccaggaagaaaggatttatggggcctgaggttatacaattgggggtgctattttaagaaaaataatagaaaattggatacagccttgggaggggcccctcatgtaagtaaggctttaatagtttcttgggaaatcacctctgtatgaagagatgtgttgacatttaatcttttcccagttacattttaaaataaaattgatgctagttatatttctttagagcatttattatttctcaaagacaaccttttatttaatgcagattagagagttaaaagaatttataatggtaggaatttgacatttctgcctttcattctgaaaagatacattgattaaagtgatgtcaaactcagttaatggaggcggtgcagttatttgaaatatacagggtatataatttgaaggcacgccaaatcacaatgacaaggaataatgatgaccttggtttatttttatacagtacattcaggttttgattggattcagagagaggcaatggttttctttctcacaaagtcctgctatagtcctaggaggtttgtgttctgttatcaaggcagttggttcgtattggaatattttctggggaaggtcatgggctgcagtgtgggaaataaacgtttttattaaatgcaaccaggtttcatgaaaatatttccccttgtagagtgtgctcaatgcagtatactgatcttcaaaaaacaaacaaaccaagcaaataaatagtttgtagtcttcaccttttccctacgtaaaacatctattagttagacttccttggggtttcatgctataaaatattgacatatgtttggagttctgaagtttcattttaatacagatatcaaagttaaaatggcaacaccatgggataatttattattttaccaagtttggagggttttttctatttatgtcacttatagaattgtccctaaaatccttgcaaaatttcaagctccctctacttaatactaaaagtgaatgtgtcttccagagattctgataaccccttcgaatgggagagtaactctgctatttgtgaatcactcctatactaaatatagttccaagattaaaagctaaaatgattttgtttattttttcatgaaattttttcatgaaaggcttgatagtataaaaagtctgtttccctcatatattacagcatattatagcattcaatgtgccttcttaaaccagatggctcctctagagattatgaaatactttaacacccagggcatagcctttctgtttccccattcaagattacttccttgaatatggcccaacaaaaagaccaaaaaaatacatttggctccagcgttttaagggcatataaattttcttaagcacaattctgataggcagcagacaaatgagaatgaggaagggaaatggctctgctgtcttatgcttaaaagtgtcctcatatagagagaaacaacacaccctggggcctttcggagggtagagggttggaggaggaagaggatcaggaaaagcaactaatgggtactaggcttgatacctgggtgatgaaataatctgtacagcaaacccctatggcacaagtttacctatgtaacaaacctgcacttgtagccctgaacttaaaagttaaaaaaaaataaaataaaaagagtcctcatctcacggccatacaacctctacctcattcccattaaaaacacaaagatcagtactccctcttttatagctcacatcttctgtttaggctgccattttaagggataatttctattcaactctgagctcgatctttattttaatctgatatcactcgttcaaaatacttgggaatttcagtaggcaacggaacacacagagcaattttctggaggcctacaacctctgaaggtgactttgcgtagtatatgtaatgatagtaagccctgagaaaaccaatgttcttagtagtctggatttggtttagaaatcaatgtattcctgctttcttttgtgatcttttgccttctccctcaatgcctcactttcactctgtcattatgaaccccattcctcactaatgggaactgggggagaatggacaatgatcctttaattgaaatggagttgtcatttccttgccatgctgataaaatgttgttgctgttgttgtttgttgttgttcttaaatgactctttcagaatttttaactcagtattttgattacataccattttaagaaaataattgtccataaattaaaaatgctagcaaattgatgaattgattttctcatgccaatttggaaatctgaaatatatctaagactggtgaataatatgtaggtctaattgccatttgaataaaagaatctgaggaagagctttgcctttatttttgtttattattcattttagtttagttatttattttagtagaaaaatgtggttgtgtcaacgaagaggaggtacattaaaatgcattattaaagccaatgcttatccatgtaatgaaatgagaatgtagatggcttaatgggttttggagaggattaagataattttaaagaaacttcaaaaaatcagatgctcgaatcatgatgttttttgtttatatttaataaatatgaaaaccatacatgggcatatcaacaatgaggaattcacatatatatcacgaagtctcttgctaatttgtcaacttttaaatgtgttgtcttcactatcatgaaaattttgatttttaaaaaaggtcagtgttagctgagcacaattaccattacggtgtcccatattatttccaattatgggcaaataaaatgcttaccctttaaatgtttttaccctcttcttggcttttgttttgttttgttttaaagcgttctcccttcttccactctgcttttggctaagactgtcatggaatcaggactataaaagggcataaacatcagtagcttttttctcattcctggcactcatctttatttgcactcaacttgtctcttcctttatcagattacggttgcaatagtaccttagcctgagctaagtgctgacttaaagggcaagggagtcagtacactgttacaagtgcagattttagccttggaagctgtgtgaggaaaaattaaagaaataagaaagaaaaatcacaaaatcagaatggcccacgtattttcatcaaaggcaaattgagtaattcctttttatgttggtgcttaagaacgatgtattagaaataaattggtgactaagtgaacaaaatattaataaactagttgagtaagtgaaaaaataataatctgtaaaaatgatgaatcccaatgactcacatgttgcaaaataactaggaagcaaaagggaaattagactttaaagagcgtaatcagatgcaagaaatgttggcttgtaggtggttaactaaaatcgcttacgggaagctcagacagctggggaatcctgatttagtagacgctgaagggcagggcatgagccatgtgaacagctgctgaagagctagaggattcctttggattaggtgtacacaccccgtctctaatgggctgtcagagagcaccaagtgttatcacagaggttcactttgctcaagcctatggcttttgcagtgttttactttaaatgtctgaaaatggattggctctcaaaataaatccaaaaataaaagtatcaaaataagtgactctctaaaacttgtattgtgtggttttgggtgaccacagtttaaagaagggacttacagctgatgatttgttatccatttattgattcatttgtccatgtaacaaatacacatattgagtgcccattttgtgccaggtactgtgctatgctctggcgatagtattctaaacaagtgaactcaaagagagactagcatttcaaggaggatgtgcatattaaatacacacacacgcaaactacttgcattggagataagggctatagaataaagcacacattgtaataagaatgtataatagggagagttagaccagtcttcgaaattggggaaatacttctgagaaaaaaaaaatattcaaagcaaggcaaagaagaatgaggttagagtatagttgtccaaaagaaaagagggagcaaaaatgtccctgtcagagggagcaatgtttctgaatgtggaaaatggtatggagaaagatctaaaacaagtacagctttcctagagtacagtgagggcagaaaagtgtggaacaagcttgcatctgaatggccgactggggtccaatcattcagagccttgaaggttatagaaattatttttctctttatactaagatcaatggacagccttatgggtttcaggtagaaaactgatgtaaacatatttgtattttttaagactatcactctgttttgtgtgaaagagattggcaagtgcctagggtagatgaaggactatcaatctgaagcaattacggtagctcatccaaaagaaggtgatttggactagaatggggacagtggagatgaaagaagtaaatctattcaagatttgtatatgagatagaatcaataggaattggtgttgtattgcatgctgtgtgctccatgaaatgcacacctgggtggataatggtgccatttgcaaggagattggaagggaaattggaacaacaggaaggattaggggtgtggatgctaaggtgtttgttttgttttgtatttttatgtagcgcgtgggtattgtgcctagaaatgaagtcattattagggatttaaatatgcaactcatggagtggatgagaccagctagaaagataatagagtgtgaagaggagatcggaaattcaataaagaagacaaaagcactaaaaaaaaaaaatcagagaagacacatctagaaaaaatgatgaaattctaaggaaaataatatttccataaagaggtctgttcctttcgatctccaatttaatgacttcatgaatgaggatcccacttttagcattaggtgtcttggtttccacagtctctaccatctatttacccctaatttcctcccatattgctatttctgtgaatattaccaaaatgttgccttagtagaaaagcttcaataaatatttaaattgtataacgtattcagctttttcctgtactctgcacttcctaaaaataccttcttcggaaaccccatttcaactgactactgtataatgaaatgagccttcagtgtaaaacatttatcatagtctcaatttcaattgctcagtcagaattgttgagtaatatgaaaaatcatcctttagagaatacagaattgcatagttatgacaaggtaagtttgcactttatttaatgctagtttagttaatatagatgcttattggagaaatgtctaaaaattctggaggaccgttagtgaaagtgattatcccaatatctgcaaaaatggtaaaaatacctagaaaacattgacatttcagtttaaataaagccagaatcacaataaagagatagaaggcatttgagtaattcaatctaatcatggatgaatgtaatgtacttatcagttagctttggaggaagtaagactcgatagaatagtaatatgatattgagcaactttttttaacattaggtttttaattgcttataactcaacattgttgaacacctatgttctctttgctttttatgagacagcaactctaagtcagagaacagatacacacacatatgtatatgcgtacaactactataaaatatcaagaaagttataaagcatggtacaaatcaatcataaatgattacttatgaatagtgtgattatggacattctcattgaagaatccatttttataaataggcataagagtatggacatacagagatgtgaattagagaatgattgcaagaagcagtgaggcaaaaaggattaatgaaacattgatctgtcttacatacacagctattgacagtaccttgtgtgtgcatagcactattctagattcacctaatcttcaatgataatactgtatttaccatttaacaagcctgtaataagtgtcaggcacttctctgattacatcacatacatatgtgataagttccatattaactctagaaggtggggaaacataatcatctaaatttaccagatgaatatgtagaggtacagggagattaagtaatttgcttaaggtagctcagctggtacgtggtagagtcaggattttaatggtggcagcatgacagtaggattaaagattcttaaccagtcagttgtcacgatctctcagattttaatagaattctaaaaaggatagaacaaaatataaaatggcaggaatcatagtatcttctaacaagaactagacatgtcccattgaggatgctctttaaaaataaaacccattaaaattttgggttgtttactcaaagcctatagacattggcatattatattttcttagataaaaactgagatatcctaaataactcatgcccattctctagacttgcatagggagctgtctatgataatatccataacagttatcttgtttcacaattttattactatctcactcttcttactttgtgaagatgaaaaagatcaaaaataaaactaatgcagccctggtttgtttgtaatcatctacagttagccatccttagagtggtctcactagttgttcttttagagtttatttcagttatgtacaggcaactgtgctacatgaacaaaaagctaagaactgggctaacctgaacatgatttagtattgtaaaaaaatggtttacatagattaacgtgccatactattctgaatagtacttggcataaacagtaggttatttaagttactataattactgttgcctttttacataaactaatttttctcttatcttcattatgttagtcatccacagtgtgatatttagttgcatacattcatatagtgtacactgtacaattctagagtgtaccagtaacgtggactattaatattatgctatgaggtaaatgacacccctggagttaagcaatgtgcactctgtacgataacgtcaacattggcattctcatatatatgattagaaataatactgagtttctctgacttcacaagcaattttattctctcatctcataaagaggtaatgaatgcacacatatctacatatttaaaaataatgtcagagatcgtgatggaacagaattattcaagatgtataaatgagggtgggaggcaaagggaagtcagaaatactccccaataatttatttcaaattaaaagcctattggttattggctggtcgcggtggctcatgcctgtaatcccaacactttgggaggccaaggcgggcagatcacctgaggtcaggaattccagaccagcctggccaacatggtgaaaccacatctctactaaaatacaaaaattagccagacgtggtggcgtgcacctgtaatcccagctactcaggaggctgtggcaggagaatcacttgagcccgggaggtggaagttgcagtgagcggagatctcgccactgtactccagcctgggtgaaagagtgagactctgtctcaaaaaaaaaaaaaaaaaaaaaaaagtctattgattatcatgtgcgtttccatggtatcaattgtttagtattgtccagtaactaactagtatataaaactatcaggataatataaattttaacatttatttaaaatgcatcttcttaactgtaaggttattgatctttggataagctatagaaataagccttaattcagaaatatatttcggagacccagtaggttaatttgtagcactactctttaatattaaatatacaaatatacattgtttttataacttactgctataatgacactaagatgtgtgattatataaaaataagaaattgttagaatttattttattttaatcaatgctgatccatttttctagtgtatgagattagatgaggttgtatgagataccacttttctaggaaaaaagaaagtctttatgacagtgtgatgaatgaagtaaattagctcatttctttcaatattactagtgtgcatagatcttctctttttgtctttctgtctatcatacatacacagaggcacacatacatacacattacttggaaattaagtggtttacgtatgaaagtttttggctttactgataagatcagtaacatgataaataatacaacactgaatacatttttccatttgaaaagtgtaaagaacactacaacacggttgggaaaaaaaaacaacttattatattcaaatgtcattcccaattgtaacaaacatataattatttatttcttaattaagaagctattaataatagtactttaatattcaacattagcagtaactttgttggtttcttttttgataatttgtttaagaaaattagattataaattctgttatggtaaaaatacaaaaataaagcaaagtattatcttctttctatctcttatatgcatcagttggacaagatattgagattctcttttcttttaattgcatgctttcattatttttctattcaagcttcaccctgctaagttcaagtgaagtagaggacttcatgtctctagaaccaattaatgaaatttcttcgtctttcttgaacttgcagaaggtcaatagtgaccattttctcccttcttaaaaatgttgtcgtctttaagatctgtgcactgtcctctcatggcttcactactactttggagggtgtttgtattcagtctgcattgcaggctgatcctctcttctcagcctttaaaaattaggtttccttgggatctagtcctagcataattctcttctcataatgatctcttcctcgatcattgcacttatgtccacagctttattaacacttatatacagataactaaccaagttatacctctagcttagatttctccaatgaattccagaactgtgatttcaactgcctgggtggcatctccattcttatgtgatagtcacctccctctaaatgccctaaacagaactttctcttcaccgcacaaaacctgcttccttctcattgtttttcttatcattgaatggtgcaaccattcacccagtttcacaagccagaaacatatctcatccttgaaactctgatcttttttacccagttatttctaagtcattgccagtcactgtgggttttatcctctaatatattttcatccacttctctttatctcctctaccatcatcctagcgcaatatattttctctcactaggaatacagcagcctttcctttccagtttctctgcattctctttcgtattcttgataatccactctctaaacttcatgcagccaattaaattcgaagataccaccacttgttaaatcatgttagtagtttctcttggttgctaggaaagccaaacaaaacaaaacaaaacacatttaaaaatcaaagtctagacactgcctacctctcctatctcatttcccatcatgtttcctttgcctcgcccccttactggctttctttttgttccctgactaggtatagctttttttttttatctacagtacttttgtgtatgcttttctatttgtctagaacctccccgtttccccttttttaccttgatgacaccattttccacctacaagcttacctctggatagacatcaaaatcccctaagtacatcaaattcctctaccacgtaacatctgttcataacacatagcactgttatgattccatatgtatgtacgtgactaattaatacttgccagtcggattatgtggtaagttctatgaaccaagacacctcaactgttcttgctcaccactttattacctggaaccaaacacattaggtttccccatatatatttttaaataagttacttgatgtgtaatgctttaatgaacataattacagatgtttacatataatatgttataataatgatattttgattgcattttatgaaaattttatatgacaaagcactttcattttggttaaagcttcatatataaatatataataaagatttgctttttgtcattgggtgctgttcccttttttgatttcccatactgcttttcacttgtggttcttgattttgttttttactgtttttaacccatgtcctttttctttccttaatctatctttgtaaagtctcaaagaactagtatctagaatatataaatatcactcaaaactgagcactaaaaccacaaataatctagtggaaaaaaatgtgggaaaagccttaatagacatttcactgaagaggatatacagatggtaaagaaatgcataaaaagatgttcagcttcactagccattaaagaaatgcaaattaacactacaatgagttatcactatacacctatcagaatggctaaaattaaaaaaagaaaaacagtgacaacactgaaagctaacagggatgcaaaggaactgggtctttctaatattgctgatgggaatgtaaaatggtacaaccattctagaaaacagtttaggagtttcttctaaaattaaacatgcagtcaccatacagcccagcaattgtactcttgatatttatcccagaaaattgatgtttatgttcacccaaaaaccttgacatgaatgcagtagctagaaacaagaaacagctcaagtatccatcaatgagtgactgttaaacaaactgttatatactcataccactaaatactacacaacaatttaaaggaatgaactactgatactcaatattcacaactccaatggatgtcaagagcaccatattgagcaaaaaaaagtcaaaggttaaatactgtgttatttcttgtatataacattactgaaatataattatagatattaagaacagatattgatattaagaacagatattggttgccagaggtcaggaataaggcagagggtatgctatataatggtgccacaatggagccttgtggtgatggacctgctcaatattttgattgtggtgtttgttacacaaagctacacttgataatgtcgaatagagcttcacacacaaacacacacacacacacaccagagtcacacaagtgcatacttgtctatctggtaaagcccgaataagctctatgaattatagcaataatttcccagtttttatattgtactatagttatacatggtatcaacattgggagaggtaaagtgaagtttgcacaagacattgttgcatatttctttgcgacttcctgtgagtctataatgattgcaaaataaaaatttgaaaaatacagcattagacctttaataagctcttggttttctgaaggctagggtatcatcaccaaacctaatcgaggataagtcttgtaaattaataagtctatcactcaaggtacaaaggatggtttaatgctaatctgctagaatgcaatccatttctattatatgggaacgtgcatcactgattgaataaaatatcatgatgatggaggccgtattctatatgtcctactttgtaaggtgttgtgtttcaggttgtttatgaccaaaaaccctatatgacaagcgctagaagttatgctggtccacgggcatggtaacttgacaatgcctgagactacctgggttttaaacttgcctctacctacaaaggcaagtaatcctggacaagccaatatttatttaactagtattaattgagagcctaccatatttctggcactgagctgagcatgtctactactgtcctcaagaggaaattaggaaaaataatgccccttcacaagcttacttattgttggctttaaaagggggatatataaagtttcttggtgagggtcaaagtgttgagaataatttttctttgtattattttaactattattgttaatcacaaataactaatgtatataactctaaaagataaatgtacatttggataccaacttgtataaacagatacatagatcaaaagactacctctgattttatgtttgtgcgtgtgtgaatgatctccttgctttcaatctggtcttcagaaaatcccaccttgtaattgctgcccccgttgagtttctaaaacaaataagattgtgtgcctccagcttaacgtcctttagagaatcttctagcttcagggtaaaatccaaggtcctaacgtacaaggtctttcacagtatggcatctgctcatgtctctcacctcctgatctgctgttccccaccaggaacacttctgtctagatataaaattactttggttcagcaaataaaataactttggttcatgtaattttgtgtctatgacttgttcccacttcttggaatgttctcccaaaaaccactatcaccatgtctcttccaccaatgactattaatattatttttatctttccttatagaatattgtttaaaagaattccttactaccctaggtcagaaaatggggccccaatatgtattcttattgtaaactcactatggataattctagacaagcaattatatcccctattttagctgtcagtttgcttctcggcttctgactcactctcttgctccttgaggagatagcctgtgcttattatatgtggattaattgtgcctaacagcttgtaggtacacaaatgaatgactacacagcatttatctgactattgtttagccattacatcactgtatacatatttgaaactcaggcatcattcagattggaaaagccttatgaatactggcatgcattattttgtacacacacacacacacacacacacacacacacacaaaatagaacaggatgggataatcctaagtagatacttttttgtccagtgtactcaatatattgtaaaaattataaatcttagactaaaatgttggttgcttaatttggatgattcatataatctgtcgtgtttttggttatctgtgtactttgttttctctttctttcttagtctcaaaggaaatgtccaagttaaaaaagagccccaatttgtggggattcctttgaggagttacaaagctgagatatcttaggagatgccaaattgatgcaaagtggtggagaggtgagcagagtagaaatttggagaatcacttctgctcctatagtgcatgcatgccagggctgctgtcctttgaggtgggcacaggagctctaagtccagtgggtgtctgaggacagattactgagaaagtgaatggttggcttggactacctcaaagacaagtgtttgctcctgcttgagctattgttggaggtttcctgaaggagacttagaacggaatgtccattccagagagtattcagtttcagtttgctgcattcctaagcttattttccaccctgggagctggccacaatgattggaaatctttcatctgttttaatctgggattgagctcatttataaaaggaaacttagtgtctggataaatatgtgtgcacaagcatggagccccatacaagtatgcccaaattcaaggtgagaaatgtttattgcatgactcaaatacatggaattgaatggactctgaaaacaaaaataggatctacagagccagtctaacaacctattcatatttattatttttgcacttaaatgtttgtaatattttattgaccagtgaatatgaactatattttgtatattacgttaacatattattcatgtaataatgaatttttaaaaactggtgtcttgaaccctttcaatttccaaagtattacagaaatccacagatctggtatgcacaggcattttatgagaaaacttagcttgagtgatatcattaatttactgaagtagtaggccctctgacctgcttttataataaaattaagtttctgtaaactaataagaccatagtaactttttctttaatattttatctttgaggagatttgttaaagaggcttgtatgtgacatgacaatctattttgacttataaaatttcaaccaaagaaaagatgcgatatagtatctttgttcttatctatgacaatttttatgatgatagttccataattaaattttttcttaatgaaagtgtatattattgtattatcttcaactaaattagatcatataacccaattttgatctccgtatgccaaaagcagagaattgaccagccagaaaaccatccaggccttatataatatattgtgcctagatgaaagcttataagcattcttctgcctggggctcacattgtagaaatgtggtgtgcaattttgaaagttgaaaatatagactctgattgagaaatggaaaagagtagagttctaattcatgacatctagaaatcaagttctaccactgaaaaattaatttgcatatattcattatcttttatagtgaatgataatgataataaagacaataaagataatatacatataattggttttataaaaactatggcaaaaaatatattaccattctcacttgtcagatgaggtaactgagtctatattatttgaaatataactttaaaaattatattatctccgctactagattatatactcctggatgccgcaaaccacatcttctatgtgtttatattctcatagagttttgaatatttccttgtactaggaagaagttttataaatgtgttttgaattaattaatatccaaaagtgatggaaagaattataagttacttataaatttcttttgtttcaaaccattagatgatgacacttaattttttgggtataatatgatatggaaagactctcagataacttcaaaaactagaattatgcatacatacactcagatttctaaaaataacatgctatcaattcatcctgcctgccaggtatacaattcatttgagttttgcatgcgcgtttcaattgttcacattaaactgtattcatagatacaaattcacttttggaatcttgggtacttaaacaaaaacatagcctttctaatagaagtataaaaaggatactaattgatgaatataccaagtatctttccaattgcaggaaaccattaaaattgtgtctatacactgtatctcttttatcaaagactgtaacaaaatcaattgctatacatattgaaatatttatgtatctggtatgattacattagcttcagagtggttccaaatttaaattcccattggagaaaaatggagtgagaaatttgtacataagagagaagaaatgttttcttttttttgagacagagtctcgctctgttgcccaggctggaatgcagttgtgtgatctcggctcactgcaaccttcacctcctgagttcaagcgattctcctgtctcagcctcctgagtaactgggattacaggcgggtcccaccatgcccgcctaatttttatatttttagtagagacggggttttgccatgttggccaggctggtcttgaacttctgacctcaggtgatctgcccacctcagcctcccaaagtgctgggtttataggtgtgagccaccacacccagccgagagaagaaattttacagttagaatttatttggacacattttagaaatttttttcctgtaaaactcaagtttcatagtgtgtacgtgaatgcatctgtgtgagtgaacacctgtgtatttgtgtgctataaaaagatgaacacaggaatctaatagcataagtcgcaaggtaagagtattgtccaactaaaatagctaacttcagaggtatgaattactttttgttggtgggtatgattttaacattcccttgaatttattattgtaatatttgccactaaaagaaaaaaatcatggcttagaaataaatttaaagtaaccaagatcattgctatataaaccagaatttaaattgagggtttttgaaccattagggtatatttcccctctggcttaaatttgaaaactgatgaaattttagatctcagcacatttaatatgtctaaacaatactcatttgactgcaaaacctgtatatgtaatttccaaggcccagaagttcagtatttgaaattaaattgttgcatattactgagaaatattatcttaaagcatctgctccttctgctgttctaagttaggtgtgtatttctcgttagtgctcagtcgatgagtacaaataggcatgcagcatgagagcagagcattcatttcattgactgcaattactaacatgatttttgacatcttattcattgggagagtgtcttttaatgttaatttgaatgaatgggaatactttcacattcttaatgaatctgctcatagagtaaaataaaacatgactgttatgctttgaagatcaagaatcttcttttacacaaaagggtaaaaaaggccaaagaaggtgaagtgacactcttcatgctagttccaacacgagtattttgatgaacaagaaaaaaagccttctttagatgtaggtgaactgggtgatttggcattccttcctctgaattcccagggtattttgcctgtttttctttaactgcatgcaattcttgtcctttatccactgtttacaggtctgtttctcacaataggcggtgagtttatttacacagtgactgctgttacatatcacatgtactaagtctctagtgattgttgcttaacgatgactgaattgataggtcctagcatggctgatctctcacattattcttgtttggtttgggtttgggtatgaatggtggaaagagaaatggctggctctgagcaacatattacaatgggtttctagcatctactcctcacctagtactagcttagacagtgagcaaaataaaaccataaagcaggccaggcatggtggctcatgcaagtaatcccaacactttgggaggccaaggcgggaagatcacttgaggccaggagttcgagaccagcctggccaacatggtgtaaccccgtctctactaaaaagacaaacattagctggacgtggtggtgcacacgtgtaatcccagctgcttgggaggctgaggcagaagaatccgttgaacccaggaggcagaggttgcagtgagccaagttcgtgccactgcactccagcctaggtgacagagcgagactctatctcaaaaaaaacgaaaaaaaagtaaaagtaaaaaagctaagaaagcaaactatgtgttgtcaagaagtgtttatttttgcatcttgaatttttaaaggaggaggttcagatctatttgttagatgacacagggtttgtgaaaactcttgcagaccaatgaaatcagaacatacaggcacaccaagtgcagattgtgtttagagccactgttctaaaagcaggtgtaagagggttgcagttatatcccagataagagccttagggcattaggaatgaaaaagacaaaatgcaaacaaaagatatttagatatttaattagtaaaacttatttgcgcgggtaatgaggagagagacaaaaatagtagagagcaaatcatcaatactgacttcctgatttcttactagggcagtataggtgtacactatatatatatatataatattatatattatatatatatatataatattatatattatatatatatataatattatatattatatatatatataatattatatatataatattatatattatataatatataatattatatattatatatatatatataatattatatattatatattagtactacttccttttataaattggacagaaagcttatatgtatagaaagaaagatcaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaaagaaagatcaatattttttcaaatgtccagccaattgtttaagtaagttaaggtatgtaatctaaacttataatttaagtttaaagaaaaacattagaccaaatatttagccattttgatgtagccaagtttatgcttcaggagagttgcatagttatgaattgagctcacagaaatacaaatacacacgtcatcatagtgtgatatccagcatagatggggggcagttatcataaatcctgtcctaggctgggtttggaatgtgagacagattttataataataatatttcatctacataaaacagtccatttcctggactataaggatcatgataccatttgtttatcatggctacaaacagaacaggaagtagtatccttcaacagagaagataaattataacagtcattatttagaatatttgcaattcctttgtgtagggctattctttgttagctgaaataaagctctctgccttgattacagttatcattttgtgaaaatattgaatgagtttagattcctaaaggaaattagaagttgagtaaaatgtacattcacttagaaatttccttgcagtgaaagatgctgattactataaatgaagacagggaaatttcattcatttaaagagattactacaggtgacaagtttaaaattagccttaacttaaaagttggaaaatattttttcctgctagagactaatgccaactccgtgatgtatgtaaggtcatgttatcaggacccagcttattgctgctacctcctctcctacccttctcctcatctcttactcctaaccctttagccaaaggctcctatgtgcgggcccccaaactaccatgctttcgtgttgtcagggataagtcttcctgaaattaccctccttctccttaccaatcacttaattaattaaagcctggtttccacttcatctcaggaaaaattatttcctaacccctctcaccaatctccattgactccgccaatggaggttaggtatggttttaaagtgttctcatagcataagttcatcaaaatgcacaatatctttcaccatattttgtcaatttatttactttaatatgagaatacaaatatcttggcatgtttatcagtgttacacggatactgttattttatcatcatgtttcccacctctcccccatacctagagatgagcataaggcttaatatataaagttatttggttaatgctttttttgaataaacaaatacatatctaagggcatgtgagcaacagagttcattgtaacactatgcttacagttaatcatctttttgttattgttctagcagcaagaaggatatatatctatatatatatacaaaggggagaatgagaatgatctgaattcaaatataaaacattacaaatgaataaggaatgtattattttgctagcattgccataacaaaataccacagtagactgggtttcttaaacagaaatttattttctccacagtagtaaaggctaggtataatcagggctgatttcttctgaagcctccctccttagtttgcagaggctgccctctccatctgtcttctcatggtctttcctctgttcctgtctgtgttctaatctcatctttttataaggatactaatcagattggattagagctcaccttagtgacctcatttaaccttaaatacctctttaaagaccctatctccaactacagtcacattctgagacaatgggggttaggacttcaacagacgaatttgggaaaggggcaatttagcccataacaaggagccctgtcaaataaaacagctttgagagcaaacaaaaattggcatctgagtgaaatatgtgggaagaggaaaataacttggggctttgctgttctcttcccactcttcctgtgacccgactggttccctgggaaatggtctttggatccccactgctgcttaagagtctgttttttttcccctgagttactgaggactgctgtcagtatgattgtagtgcaaattgatcctttgtgggaagtacaatagcaactggtaaccacaaagtaccagagggcaaaagaactgtagacgggtaaataaaaggtgtccgaaaagagcaaagggctggaagaatgggaaaatggagaaagtaagatatgcattgagaagactgatgattttttaaaatagtagatgttagatagatgatgagagagacagagagagagagagagagagagatggttaaaggaaaactggtatttggtctgcagttttgctgtttcaccagcttaacaccctacagtgaataacaaggtcatagatcatcacaactgcagaaaacctggagaatattttccatttcctcattatatagatgtggaaagtgagactccagttctcagaaacagttagatacaaaactaagacccagctagttctcagccagtgattttcatatcataccacacgctatacagttgtaggtttagaaaaaatctatggtataagaggaccatgtagtaccttacaatgcttctgtaatacccacagcatcataaagagtaataaatttaattattgcaacttaatgattcaacaattgtatatgtatatacgtaattatacatatatatgtgtatgtataaaatctaccaatacatatgtaatgcacatgtataaaatctaccaattttctatatatgcagaaaacaacaacaacaaacagtattagagaaaaccagggaattaagtcaaaatcatcactcccagacctgaaataaatttcaaaagctcttcgttactggtcctttatttgtccttcctacctcattttttgccccactcatataccacacattgcaactatgctaaactaccttattttttttagaaaaggacatcctcctcatacctacatttgtacatttcctttttatttgcttttttcctctcctgttgccacagtaaattcctaagttttctctttaaggatctgtggcctgctttggatacagttgagtgtagtgatattgtgccttgcacatatctctagaacaaaagttattctgttatagaaattacttatttactatcacttaagatcatttattaccatttactatcatactctaattcacagaaggcaaaaaataaacccttgaatggcaagaaatgtttaggcaatgttgggcaaattgtttatgaatagtgattgcaattaacatagagcttcatacttactggattaaatattgatacttttgagtcatatctctactcttagcaataatattggtgaatattctgtgctgtaagcaatgtaaatcataaaaacattctaatgtgtatatgggtattgaatattcaatgatattaaatcaatgttcaattcatatagatgattcttttggaaattaagaaatggatcccattttaatgagttttccccaacataaactatactttgttaagttcaacttgacaatttacaacgctcacatagctttcagatgtatacttaagatatatggaaatgaaaagcaaaatgttgtgaacaggaggtgacaagatattttaaatttaatcatcatatcttttataattaaccttttaaaacatttaattggcattattgttagaaaactttagctctggaagctaaatctttagaattgttgacttgtagacaagtcaaatatccaaaataaaatttcacccatcattagcagtagatgtatctagggtgaaattacacgctggattacttcaatattcttatatttacatttttatttttttcaaagtttctccagtgagcattttattgtgaaaatattaattatattttaaacttatttttagtttaagatgagaagatagtctttggggtagataaatacttttaaatctttcatttagaagttcctggactaatattatccaggtcccacttccttaaaaaaacctaatgtaacctttcccatataagcattgactgctatttcttgtttcacaacatttatgtggtatgtctatgcctatggtattgaatatatatttgaactctgctggcctattcccatctctcacagatcccaagacaatagagatcatgtcttacccatctttgtatctcttacagaaaatagatctcaaattctacagaagatattgaattgagagtttgagatgttagaataagaaaaggcagtgaaaggagagcctacatgtagcctaggccagatttacaaaagcagtagctcagaatgagatagggattcaacaaggagaaccaaattatttggtagtaagttgttgctaaattgtgggagatgaggaaaagggaataatgatagcagactccctgatattaatcccccaagagtgctctatggcacagtaattattcattatgggccccctctgtttggccccacgcccccaaaaaagacttctttagtcataaaactgaggggaatactacatactaaatccccttagagtttctcaatgtaatgcatatgcaaagatgctctggaatcctgcaggaaagacagctgtttaacttttaacctagtttcccaaactcatttcaccatggaacttctttaacatgcagtcaataaatgcccatttatctaatgtttaatgaagcatatgttggaattcttaaaattgttaatagctaatcaccgtgaggaactggtgagatgatggtaacattaacagaagtagagaaaccaggaataggatcaaaattggaggggaaggggaaaagggccttttgttttgagacatcaacttagaattgttgatgggctatccaggtgggtagataataaaagtttttgtgggggaggactaaaactaaagagttagacttaagagagaaatacttgagaatcacttacatggagatagatgatagttgaagttaaagaagagaacgagatttctaacggagggaatacactatcaaggaaaggattagagaaccctgggggagtgtgaatatttgtgcctcatttaattttcagaaccagatcatgaggaaagaatacttcccattttagagattaaaaaacaaaaccgaagcacagtgcttaagtaactttctcaaggccatataactaataagtggcagatatgagattttgagccctactctaaaacttgctcctcaatttgaatgtttacatatttatgtaaataatatattttacaatattaaaaacgtttttgtagagatacaataaccatataattttacaggattgtcttttttatttacgtttttctttggagtataatacatttttaattattggcctgagaagaagatacaatagattatttttggcaaatggtgcactcattcatgagagacactgtattttctaaagcaggctgatctctgcataatactggctccctgaaaataaatccttgctgggccgggcgcggtggctcacatctgtaatcccagcactttgggaggccgaggtgggagcatcacgaggtcaggagttcgagaccagcctgaccaacatggtgaaaccccatctctagtaaaaatacaaaaattagccgggcgtggtggtgcatgcctgtaatcccagctactcaggaggctgaggcaggagaatcgcttgaacccaggaggtggaggttgcggtgagccaagatcgtgccatggcactccagcctgggcgacagagcgagactctgtctcaaaaaaaaaaaaaaaaaaaaagaaagaaaaaataaatccttgcaatttatctgccatattgaatttgttctggaataatggggataaaatcaaaataggaaataaagtatcaattttattccactattattttatttattattttcatcttagtcatatggaattatatttataggaacatgttaaaatgcattttcaagataattattgcacacaatttaaacaattgttttgagtgactttttgtagaggtagaacagttctgtaaaattaaggtttggctttgctttgtttgacctagattccctattaatttcaaaataaatgtgccttatatttcaaaatcggatttcgtatatgaaagctcatgtcagttcacaacaaaaaaaaatcattaaaaaagaatagtgcgttattttattactgttttgatagcaatacctgaggataccgtaaatgtgtgcatgtacttttgtttacaaataaaaaacagttatgagaagacaaaaaaatctaatgtagaataatttattccactaaaacccagctttcctcatggaaatcatgcaacacctagtgagattatgctagcacatagggaaatttcacaaatgcacattcttagacatattaaccttctggatcagcattcaacaaaggtaaaataatgtacgctattgatatcagactccttagctccctattctggctcccttttaactatcaaaacacagtaatctgtgttttccttctttgtacatcagttattgtacctgccactctttataagcattcacttttctcttgtttttaagcacagtggtagcaatggccatgacttagaggcttaatgaaatgaaggacagattataaacaaattaaacccacactgctttctttatagaagcagctgcagagtgttctgaggtttttttttttccttgttgagtaaaggaactaataaggaaaatttcatggcttcaaggtctagagataagaaatgaaagttgtaacaggagaggagctgggaaaagcacagaaatgtagatttcgcggatcatgatgaaagccacaggtgacttggtgaccacagaaatgagaacacagggttgggtgtctaggcaggaagttgggaggctggtggagtcctggttcaactctaaagtctcagttatctcagcacatgctcttgtggtgctgctgagatttggctgattgcctaccccaaacctaaaaatagccgagcctcattcttttgtagtggcagccagaggcgcagctgtgtggggactggctatctttttccttagctttgacaaatagctgagagttggtgggcttgagtgtgcacctgttgagacagaaagtgctgagtttagttgacaacactgctgaaggtaatttcacactttcattccaattgatcaccgaaacttagaaaaattttctccttttctaaatccttctccttgcccatgaatatatacatacatatatttttctcgaactgtttgagagtgattgttaccaaaggcaattgtttttaaatcagaataacaaatctcctgtttgagtggctaactcaaattttattttcttatttaatttagtagaatttaaaagatttaaaatagttttgaaattaggaaataatatttttattcccataagtctaaaggtacaatctagcccattacatcactataaaaaatcatctccatatttattagattacaggatattccgctttaaactagaatttgcgttgcatacatttttgcagaaaaactcattcttaattttttctaaaacagtagattggatatgtgttaaaggttcatgttctagtacttctttaaatgcttattgtcagctttataaaatcattttatcacaaaaagttagttttctgtaggcttattttccttgataggattccttctcttacaaactggttatatgaattaaaatgtaaatgttagtgaattgtcatatcttgtaaatatactagggtagaactgatatctttatgcaaattagaaaaatattttacagtatcagttatggagttttttttctactcttcctttttctttgttaatattggcatgtgatgaaatcactactttataagtttgctactttgattaagactcagaaatcagagtggctgggtgtggtggctcatgcctataatgccagtactttgggaggccaaggagagagaggatcccttgagcccaggagttcaagaccaccctggacaacagagtgagacctcatctctacaaaaaaaaaatgaaaagaaatgagccaggcatagtgacaacacgcctatagtcccacctactcaggaggctgaggcaggaggatcactggagcctaggaggtcaaggctacagtgagtcatgatctcaccattgcattccaacttgggcaacagagcaagattatgtctcaaaagaaacagatcaatcagagaagtaactttaaatattttaatataaaaaaaggcaacatctcttagcaaataaaaatagcgacgtccttctctttctgtaaatctatccaagacatgagtgctgttatcgattcggtttagggttttgttttgtaatatttttttcccctttcacagcaatacattttggggtatggtttgctgacaatattttccacagtaatcagtggcttagctgtaaatagaggataagtattgcatctggggaatacacattagaaacaattggtatttctggttcatataaaggtggaaaaatacttggccagatgggcacttatttatttattttcctgaccagaaataacaggcaatgtgtgagaaagtgtggaaagcactgggttggccgtcaaaagcaggatcttacaaaggttgaaggaagctaatctgctgagaggttttctttttttaatgactttcacatagtatttttcaaagcctctgtgcattaacactcacgccaaaggaaatgatttgttttttcaagcacttggtcagtgcaatagctccgcagctaataatgacatatggcaaattttgagtacttactttgtgctacgtactgtaataagagctttgtgtatattatgtgagtaaatacttaggacaagcctgtgagagagctattattgttcccattttacagatgaagaattctgagttagaattagactttgaaagtcaaactttctccttccctatcccttgctgttatccaccacatcatgctacctccctgagctcagtgattacctacaatgaggtttaccagcttgtcctatagttacctgtgttataactgccatgttcctgaaataaattaactataaaatggtgcccatcgactgatatagagaccagtcattttttttttatagttttatctggcctggggttatcaagatactaggtttaatagaacttacttccagatttaaatgtctttgttcattcatgaaaatcaattgattggatccaatgattttagatctagacaactgtcagtcatgtaatctaactaactcattgtttaaagaggcaactgaggtgctgaaactttcaataattggattaattttatctttagtcagttatatcattagaacctaggtctctatttcttaatctcaaccaaaatatacatacatacatatatgtgtgtatgtaagcaccatttctgctaatttacaaaaacctagcaaaccagtttaagaaaaaaaaaagtttcctttgctcatgtaacgaaaaagtgaagaggtattacttacttcagatacagttagttttgggatctcaagtgatgtcacctagcccagtacctctctcaccctttctccactgtgttttcaaaggctcttaaaaaaaaaaaaaaaaaaagctcttagacattatctctcgatatgggacccattattagtcttagacttatatcattgtacctcaattccaatagaaaatgaaaacaccattctctccaacagaagacctaggattacttgtaattgactctgaagaaatcacctacacattcctgaatcaatcaacctagttcaggagtacagtgttctgattgggcaggttccatcagacacccactcctggaaccagagccaggtaagttcaacccaaaactgtcagagaggagcaggggtgggtaggccacaacgaacagagatacaacaagacaaacagtgaagaagaagatgaaatgggtagcaggcataataagattataaagtcttgtaggtcccaaactctgtgtgtatgtgtgtgcatgtgtgtgtgcgcgtgtgtgtgagtaaccctcaaaagtatacaagtattgtgcttcctgtaatgacagacacccttctgttgataataatgattcatgtagcccaagaatataagaaagtattctgtttgtaaaataaatatttagaatgggaataaatttgtataaacagaagcatgtttgattttctttaaaaagtgcgtgataaatatgatgatcccaggaggtttgttcgttatttaaatgtttaaacatgtgatatgtctctttcagaataataaatagtagggaatagcaatatagcacttttcggccgggctcagtggctcacgcctgtaatcccagcactttgggaggccaaggtgggcagatcacttcagatcaggagtttgagaccagcctgaccaacatggtgaaaccccatctctactaaaaatacaaaattagccaggcgtggtggtgcacacctgtaatcccagctactcaggaagctgaggcaggagaattgcttgaaccctggagacggaggttgaggtgagatcgtgccattgccctccagcctgggcgacaagagcgaaactccatctcagaggaaaaaaaaaaaaaaagcactttttaaaaatcataatggatttctaagattgtaatagttttggtatgctgattggctttatttttggctacatttattttagaatctctgcattatcaatgaactttcattcaatttcttttctttctttttttttttttgagacggagtctcgctctgtcacccaggctagagtgcagtggcgcgatctcggctcactgcaagctccgcctcccaggttcacgccattctcctgcctcaggctcccgagtagctgggactacaggcgcccgccaccacgcccggctaatttttttgtatttttagtagaaacggggtttcactgcgttagccaggatggtctcgatctcctgacctcgtgatccgcccgcctcggcctcccaaagtgctgagattacagtggtgagccatcgcacccggcccattcaatttctaaattaggcataaaaacaaaattatttcgtaacatttctacaatgacctcctttttctgttaagtttctaattctgaagacccaaattcaattttatatttcagtatctcacactgattattctgatagttacattaaatccctcgtttagaaactgatgcaagttactgttttcaaatgttcatgctttgaaagtacatgtttgtcatctgatttcaaatctgcatggttccatgctgattattttagataacttcaggctgtactccaatttttttctgagagatctctgaagtaagcttttcttactctgttacaattttaatgagatacattctatgtattagagtgtgaaatatctctttaggacaaaatttaatcatagtcagtgctccttatttaaaggctaaaggcatcatcaatttggcaaaaaataaacaacactatctggctgcctgagggtccagtgactgaccttgagttgaaatcccagctgcctgcatcatgtgaccatcaacattctgtttttatcccagtggtaataaataccttatactcaaaaagacaagagcaactcagaagagagatttggtacttttcaaagaaacgcagcagtaaaagttgcatgatgcttttcatttcaaagcaggcaaacagagctttattatggcagagcagtccaatttaattttcacttgtgtgatgaaactattccacacgtttgcattaatttatgagcctttgtctggttttaatgtatttaataatacatttatacactctttgttttaaaaataatgatatgttttgacaatgcactttttcaggaaaatctgaggtgtaacaaaaagtgataatggtaagatagttcccattttgagtattaaaaaatgagtgcatcaggtaggattgggtttggctgcgtgtatcagaaatccagaaatagaagtgtgttaagtaagagagatttgttgccttgccacatgagtgagctccagctggaagcagtacattgccggtagagcagggccatggtggtcaaggacccaggaaccttccatctttctgtgcaactttcggtcttcgatgtaacatcattgtctaaaatggctgctggacctccagcctctttccaggtgtcaggaaggactccagcagagtgaaagggtttgtccaatttaagaagcgccctttacacagctttcctccaaatcccactggatatttctgcttactttcccttgcagtggattatgtcaaaatagtctaattccttcttttataacaattggagttgaaagctttgtttcaatctctagtgacaatactttagattctgattcccattctctgagggcatacatccgtgttactaggttgttactaaatatgcatgaatcttaactcaagttttttaaaattccagtttggaacccttggagaaatcaatacatctgttcgtattttgcccaatagtctctatgagtgctttatctaaaaatcataaattcagatacatttttaatatcatgagactaaagaaaatatttcccgttgtcaacagatatcaagtttcagttataaaaaatgagtaggttctggatatctgttgcacaacagtgtgcctgtagttaacaataccgtattgtatacttaaacatttgttaagagagtagatcttatgttgtcttcttattataataaaataaaataaggtcgggcgcggtggctcacgcctgtaatcccaggactttgggagtctgaggcgggtggatcatttgaggccaggagttcgagaccaacctggccaacatggtgaaaccccgtctctactaaaaatacaaaaaattagtcgggcatggtggtgcgcacctgtaatcccagctactagggaggctgaggcaggacaaccacttgaaccagggaggcggcagttgcagtgagccgagattgcaccactgcactccagcctgagtgacagagtgagaccctgtctcaaaaaaataaataaaacaaaataaaataaaatttccgtttgtatactgtctttaagacccaaatcaattctctctgactctagtgggcactgatatgttctactgaagtccccatcaccaggtagcacacccatcccctagctgctgggagtgcttgttgcccacagctgcttccttctccagagacttgttcttaccctgaagaaagccaggagcctgaaaggccatatgtgccccacctcaggtcagtttgcaaccaacgactgaaagtacaagagtccaacccatttgccacaaggtgagatcagctctgggatgcaatttgccctccagagctccctgtgggatcatgtggaaattggtctctaggtgagatcgcattcttgttttgttttccccaagccctaaactgtccccttcacacagtttctcttttgagcactttctctttttattttattttttgagacacagttttgctcttgtagcccaggccgcagtgcaatggcatgatctcggctcactgcaacctccgcctgctggattcaagcaattgtcctgcctcagcctcccgagtagctgggattacaagtggagcgccaccatgaccggctaatttttgtatttttagtagagatggggtttcaccatgttggcaaggctggtcttgaactcctgacgtcaaatgatccacccgccttggcttcccaaagtgctgggattacaggcgtgagccactgcgcctggcctattctaattttcatcccttcactcacaaatgctatgttccatcaacagcttgagtgtgcacatgagcgcacacacacacacacacacacacacttctgtgcttgctttttcgtggctgcaaacctgctctcttgtgaatccctgaatccacgtatgaagccgaagcttttatttcattttattttttagttgacaatataattatacgtatacctggttttttttttttttacattaactcttctccttatttcagctgagtttctatttatgcacaatatttattgttccgactcaggggaagtttcaagacacaaaccttttgacagcctaaattagttcaggtctaattcagaaacagaagtttccagattagaaaacctgaagctaaagaagtgcttgaagaggaacagggattcatgcaaaactagactaggtaacagagttactcatacacaagaatcttggcaagggttgaagtgggcatgtggaaggggctggcttgaaaatcaggagggtcagagaaagagctgttattgttaccctttgttcctcctcagatgtctatgcgaaaggctctctgagatgagagcacgatatagctcatgccggttcagccacttaatcttttttgatttgactgcacccaggtttctttaaatctgagctttagtttccttaactgtaaaataatggaaaaattcctggcccctcctcacctggttgctatgaagattaaatgagataatatatggaaaagtcttagcatataataaggtctggaacatgatatacatttaataaaataatacattttacttattattatcttatacctttcatatgaatgttaactgcaaaacagcatagccggtatttgctccttcacaatagaaggtaatatgcttccctgttttactaatcagaaaactggcctcgaagaggttaaattcctttcttagaactattaagaggctaagccacacttcaaactcaggtgtgtctgactctgtagtcaatgttcttttcacttcatggtgcttttttcctgtaaagtgagtataatatttcctaaatcataataaagctttgtgcattggatgacataaatataaagggcatagtgtataattggtactcaataaattattccttttcctccttccctaggcaagaactaattttctttctttgtttagcccctgtattaccagccaagtgccttgggcataatatacgtaaataggcctagtatgttgaattttaggcagccatcttgatttttgtaacaaatctagttctctttaaactattgcttagctcttccaacaataacaggccttgtagttatcccacatggggtgatttcaaagccacagagggaagattgttcttaagttactcctgcatgcagtgtcaagctctcacaactttcacaagaagttaaaaactacaattttatgtcagtctctcctccagtaatcagatagcttctttgattgttctgataacccaagagggaatccttctgatacagaaggtggctatatctcatatattttgcaactcctcccaaaacatagatcgatcatctcaaagaactacatgggaaacttgatagccttttggaggctgagaaagaaagctaagccaaccttgaaggaagtcaacaaattgtcaatggcattttgaaaaactgcattgcaatagacatctacactcatacgttatttagctcccttagggatatgattactcttggggtccacaagattcgatgcatgatcatttgagaatatttgtggctactattattttttaaacagatcaacaggcatgacagaatttcatgcatgaatttcatgataaggcattctcaattttatgttttcacttaagtgattatctctaatgttcatctatttccttcttatttcaatcctaccctagtttcaacccatccttttttatttttttcttgtttgaagtttaccctaatttcatgactgagcttctctaaattccttaattaagtcctccttgtccatcccagtacaaggtgtaatcactttcccctatatctggattgttcatctggttgttatgtattgcattaagttaatatatgcaaatataagccttgtaaatacagagaccaatgcagtccaattttgggtagatgccacattcaaaacaacaataacaaaaattaattaagtagtcacacacttaaataactcaaaagtgttaaaacagatatgaagaaatccacagcaacatttattataaaattactctttctcttccttggttttgcggcttctcgagttcataggagactttcagtttccagtgacctggaaactcaccattcctcatcaccatcctttactgtagtaacttccttttacctgaccaccctgcatagtcacagaagatgcactcctgacaagtgatcctcaaaacaggtagtaatctctttgagaagtgtgaaatgtcttttgttctccttgtcgttcccatgattgtcagctgtgaggacccttgtcattctaccctcaatcccaattctgcagggtctggggattctggggattcttttttttttttttttttttgtagttaccaatcttatatagatacaataatttttatgtgtattgatgtttattgacaaccagattttaaggtccttagaaattggagttaattattatttatcatccaagctcctttccctctgccctcttattttccaacacagtgtcttgaattttatcactttatcgtttagttattaagggtgatttggtgaaatgtagaacagactatatgaattacctcagcttatggtattatatgacataataacagaaacataaatagactatcataaatcttaactttttctttattctttgtaatattttattagtcttatccatcttgcttggattgccaagttcttctgagaattccagtaataatgttatcattctatcgagcttattattcccaactgatcttctattaagccagtatgaattagctactgtttatgagattagattatgcactttaatctctagaagaagcaaaagtaatgaatacactgaatctgccactgagaagacactttaaactgaaatgtttcattatttttctaattcctctctcttttgaatctgagtatgtttttggggtacgatacagtgtaaaggtttttgtacatcaagtcatagacttggaaataaaacacaaacaactacccttttgatgaaaatacataaacatcatagccatttagccaacttttaaatttaaaacaataaattcatgattttagttggagggtaaacatgcatctttttaaaaatcaaatgtaaacacagaatctatactcatgatgtacacacatggacataaaatattgcatatattttgggagattcaaagaccactggactccaagttaaggatatttttctctaaataaacttagtgattgaattatagaaaaccacaaactaagttattgactgaagtataggaaaagtatagtgtattaaaataaagttttggactaattaacatgattttactaatagtgacaagaggatttaccaagttctgattttttctaatgtaaaaaaaatttgttaagtaagatctttcaattagtaatttctgaaaccccctctaagtaaattaaatttttatatccttgaagaaggatgttgatcagtctcaccttatggcaagtatctcaatatatgtgatctgtcacctagtcttttctctattttattatttctgtgtttgttgagaaaaaaattatttgtatacaagtgcatgtactatttaatgtcatgtaattaaatccctttgatagaaacagttaatgttagactaataatgtttttagctactggtgaaatacttcctcctaatgcgttaaatgcaggataagatcttacttgatactaccacgggagtgtaatctctcccaatagtgtttgtttcatcgaagttggctcatttaggtagtttgagtggccagagttgtataagtatgtttggcagtggtggatggggaatggacagcaccaaaccattctttctctctgtttcgatttttctcctttgtctattgctagttgcttattcctgagatatccttcacctctctcaagaggcttggtcacttaacttcattccaactctacacctccattggtggaaatggaaagatggatgaaattttagcccctgtttatggccagcatccgactagtccttctttcaaaaatgagtaaataaaaacttattatggtatctttgaaaagttgcctgtctatgctctaggctttaactcaataaattattttaatggaaactgtgaattcaaaggaaataaaagtatggcggggaattatgcagaaaatactgtaatatatgttgataaaattttcccaagttaccacacctccagtacctagaacatagccagccatataatagacactcaataaaggtttgttgaatacatttgtttaatattcctttttactcttttcctcccctcttctttcccatgcatttctagttactcacatttataataatatattcagtacattttttgtttgcgtcaagatgcatcatgagggaatcacctgaaatttcaagtcaggatgacctggttagaacatcagttccaaaactgaatatttagagatccttttcctatctataaaattggatcacaaaatatctctcaaagggtacaaagcacagcaccaaccatatattaataataaggcactgttacataaatgtcagttcattttctcatcaccttcttaaccattttgctctctcttctgtttcaagacagtaaaatccaaatctctgtcagtaaaagtatatctgaccactctaatttaataaaatgcagcaataaattgcatgactcatttctcaattattttgcatgacttactaaaagtataagacagggtacctgagggatctgtgagggaaaggaagcaaaaatcatatacatagaagtggttggtttcaagtgattaagaataacctacgagtaggtgaaaaaaagaatcaggacaatacaatagactgcaaccaaaggtggaaaaaactgtaaaagaaatagctttagaggtctcaaatctgctttcagaatgctaggatctagttttcgtaaattagagttctcagtaaatgtaggacaagtcccagctgtactactgtagcattaacattaaaactaagccatatcttgaatctccttttctcttaaacccccagaggtttcaaaccagagaggtggtcaaaatagattcccctactacttcccctttctcaataagaagctctcatctgttgaatttccattttgaggcatttagacagctgagagagagagagagagtttaaaggagtgttcaatccatctggtctgttttttccccaaattgcggaagttatcatttcagtaacattatatgttgttaagcttatacaataagatctgattttaaaacttaccacataaccacagcaacaaatattgtgttatattgtcagaaggattgacacatagatcaattgaacagaataaagagtctagaaacatacccacacaaatatgcccaacatatttttgacaaagtttcaaaataaattcagtggaggaagagtagtgttttcaacaaatggtgctggatcaatgggacatccacggacaaacaaaatgtacatagacctagacctcatacctactacagaaattcacagattagagtgagattatttttctctttcttacagaaatcacatccatattgtctacttctgtgaagttcagtatggtagccacttgccatctatggccattggaatgtagctagcatgaattgagaggtactataaatgtaaaatacacactggactttgaagacttagtgtaaaaataatatgaaagatctcaataataattttatatgcgttgcatcttgaaatgatagtatttgggatctgtttggttaagtaaaatacagtatggatgttagttttacccatttctcattatttgtaatgtgggtatcagacaaattaaaattacctatgtggcttggatcatagttctattgctcatagctagcataatctataatttccagtttcagtttctttatatctgaatgagaaataaaagatatttgtgaagcaatctgcacatagaactaaagatttttattatttttaataaaattttacatttgtctgtccaagcatttgaatcattttgcaaccatatttattgattatttctacaacattcagtttagattttgcataaataaaaacttttgtaagtgtatgacttaataaatattaagcaggatctagtctagttacttgggaacggcaaagccctcgtcttcatggagcttacatttttcagttgataatctttatgtaactctagaaataattataactggcttaactaagttagcttttgggtacatactcaacttgtgagagcggaacctcatgggtctaccaatgagttgagtattacctaaaagtatccatcttgccctgggcattagccaatgtacttttcagaggaaatgcagggtgtttgttaatctggcaaattacctgagtaggcattggttacatggaagtctattcagagattttcctctgtactacgttgtattgactgattgcttttctgactttctccctagattctgaattcatcaagagttctaggaggggggctagcgattaaaaaaaaggacacattaggtacaatataccctactcaggtgacaggtgcactaaaatctcagaattcaccactatagaactcatttgtgtaacaaaaaaccacttccacccctaaagctattaaaattaaaaaggaaatacaaataaaaataattttaaaagtttttgctgcgtgttagcacctatgtcagtaattggtaaataataagtgtaaataaaccaactgatggatgaaatattttgagagaacattaattcaaaatttaaaccagtcaatgtcacattcaagccagattgcccaacctagtatatcatgaccattgacttcaatctttaatatggattgtctaagtcattggctggaagggagcatctgtctttgttttgtcctttgaagcaaacacttgaaatcagtttagactctcatctagacatttttgttgtttagaaatatatttaatggaatctttaggctagattcagaagagaagtaagctgtcattacccaaggattgttaaccttatcaataaattcgtagccctagggcataaagatcatttgtattgtttcagaggccttcgtgtctagtaaattttctagctattgatttttgcaaatgtacaaaattaacaattgtgagagagcttttaacaagcttgatttcagttgaaataatatgaacagtaattgttttttttctgttcattgggtaataaaagcatgtatgtaattgggaggccccaatactgttgaaggtaaatctgatgagaaacaaatattcaaagactttgtgcatgcaagagaatcaatagaggcaaaaaaaaaaacctatcttctagagagttgacaggaatctatcttatttggaaattcaaaaggtattcatgcatttctgtgttctgtgccagttacattatttatataataaatgcttttccatattgctttttatttgaaattctcaatcctataactaattattttacttagggaatataactgtatcctttacgccttctctttgattttgtcaccatgatcatcaaaagtttctccccatcaataatccaggtagactcccagccacactcaaggcatcatcaatgatctcagagtactacattggattaattactaatttttcctcattgacttctgttttccacaattcaatatttttctaattttcatttatctgcttgcttcttcctaaagaaggctcatgtaagtttgtatatgtgacaccaatatctctttaatatgtttaatttccttgacgtttctaaatagggttaatttaaatttaccttaagacccaaattatctgaatgcaagtttccaaaaaaaaaagctatatatcaggaattttctaggattcaatttcaaaaacaactttcagagtatggctaataattcaaaggtcaacaaaacacctgagcccactacaatcccagtaccatacaggtcaaaatcaagatttggcaggattgtaggatcccaacgttctttctgatgttaaaaaatatatagtaaataaagttattttttgttcaacagtattttggaagtagtaattgccacattgtatatatgtttgccattagccataaacgtgattttaccaatttattttcactacattgtgcagaattccggaaacttagataaaatattttaacacctaaatatatacacacacaaacacacacacacatgcacacacgctactcttccatgcccccaatctttctctttatctcagagttcaagtgtagccatgatttgacattacaaaatagaaagagtactgttggtttacctgtcaaattacttttatcaagccattaatggtgcttactgtgtgccagacattttttctaagcactttataaatattaactcatttaatctttataaagcctttaaatgatatatgataatattctctctttacacaaaaggaatttaagacactgaatggttaatgagcatgctgaaggccacaccattcataagtggtaaatgggaagtgactctgggccattttgttcccaagtccaagcttttaaatattttcctctgctcttactagacatgatattgctgagaaaagttttggtcccctgtgcttgaatataagtataataattaagtcatcttcttttccatgctcaaattttactctcaaaatcatttttctgtgccacacacattttaacagtttttcattatatacttgttcttctgagtagaaattgactctaaaatacagacaaaaagaaattatatttaagataaagtaaaaaaaaattctgggtgaaggatacattagaatatgtgattcaatttttacaactttcatataagtctaatttctttcaaattataaagttaaaaatctttcaaataattactagtcgaattgaagaatatgaattgaagcagtaccatttagtgcataaattcaaggacacaattttcaagttatattttctatgaacagtcctccctgaagttgtgcaaggagaaagacctaaatcgaagttagtttacctacattaaaatgcataaaataataatagaaaaataaactgaagcaaggacaataatatggattactctccagctttcataactgtgtttttaaatgttcttcagcagaaattattcaagcgttgtttcctactacagaaagaattctcaggacttctcagaaatacgtcagtttttaataataccaatacctgataggagagcagggacaatttcagtgtcattcatagatgttgtcccagaaccaagacagcatctgctccatagtaggtacttaatttgtggaatggataagcaaatcagtgatacatatcgatggtgctttttctactttaaaccacttttaaatgtgttaatatcccattaatagccttctagatttatttgagtagaaattaattcttttatttgatagactagtaaaaggcagcctagacagtttaaattgctcattcaggttcactcaatgaatacacactgaggaaaaaaaatatatatatatatatgtatgtatgtatattcagaaataaagcccagccatgactttttgttcaaggttctttgtactatattccattctttgaactgaaaagaggagaaattatagaagaagcaatgttttaaaaaatagacataaatgcataaatcaggtaacacacttttttggatacataccccacaatacctgaaaaagtagtaagcaaagtcactgatatttaatagaggaatgatctgaaaactttacaaatcaaaataactttgcgctttcaatttttagaaattaagtatttctccttactgaattcatccgtatgtagaaaattatgctgtattatttcaccataagttttaatttaggagtatgggttattatttggaaagggaaatgtttctcaaatttacttccatgttttaaagaataatcctgttaatctctttctcacatcttctcatatatcttatttcacttttaatttcctgtaagcttatcattcctgttaaattactccttgccttttctcagcgatgattgataatgatattgttgagctgtgtctctttctaacacctagactactattcaaactatatcaatcactccattatatttttaaaacctagaatatactactgagatctctcttgacctggtattcctgtatcctgccatctccgatttcccacactgagcacctttccttccttcagcatcctttccaatcagttcagaaagctgcccttaatctgctattctgttgccaaaacaacatcattaatcactttcagttaccttctttgcttcctatacatcaaaacttgagcgcttcctttaccctcagttactgctccactagagctttcttgttttaacgccccatcttcttgtcctgtgtgttttggttttcttcctcttcttacttgatgcccttgttttctttttgtgctattattaccttcattttattttctgtgcatgagcattgcaaattacaaaatcatctctttccccctttgtttactacttatttggttccggtacttcttttattctgtttgtataaatatgtactgaaagcaactgcggaaaaaacacctagatgaattgtgatcctatgtcgtcccttagctgagaaacatttcattcctgagctgtattatttgtcttttctctgaatacatttttttttcatactggctattctcctgtatattctaaacacacctttgtgtaatttaggtgaaattgttggaattataaattgtttagttagtagttgtgaatcatgcttactacagacatgtattatcaaaaatttcacaagaaggatagcgtgatactcaggcactccccacatttcctcaagccaccaaagagttttttgatggatgttcttgtttattggatgctctaaaactagacagacagtaaagattatcttttcctgctgctgaagtttaagtcatttttcccctaacttttattcacacttccaattatgaacttctaacacataaagaaaattgagatttttgtcatgcaatgctgaaacccaaactgacatgtaggaggaaggagcagcagttctgtgggtttgtcaggatgctaaggacatgttgtttttcaaattcgttattagagtcagtgagtttattaggctgaggtagaaaactgtatgctattagtcaaatttaaactaaattcctaaactcaagtcccttatagctcaaaatctgtagattcaagtaaacacttctagaaatgtcctaatatcacattgaaggagatgttcaatatgattttaatttagctgtctaagtctgtatgcaaaaaaaaaaaaaaagaaagaaagtaagtaaagcaaagcaaataataacctcaagtgccaactctaattaattggtagtatcttcttgaactaaaatgtggagaagtcccatctggcctctgtaggagagtgcaatgatctattagccatgctaatagatcagcccaggagaaggaagagaacaggattgttgattgcctgtggaccctgttgtgctagaacatttttcgtatgaaagtctgcatttcaggtgtggtaaattgtttatcagaccacttattttctgatgtgttctactttatttctgatacttgattaaaggtatgctgtgaaagtagtgtagtaataatgactcctaaaatgagtttatgcctctgaaatatagacacacgattcttcttcaataactctgcttatctgcttttagaaagtaagcccggaagtttacggactattgcaatattagattttaccatgtgtgtttattattgataatctaaaggtgaatttattaagctctacattggctaaggagccaaggctaaggattacaattaaacagctcaattatatttagcaagcaaataaaaccttaaattataaagcttccaatgatagcttaaagctcagaaatggccagttttttaaactaagcaataaatatatttttaaaatatttatttctagtgttacacagatgaatttggcacaagcttttcacttccttttgtgaaaaacttgttttgtgcatattccgtccactattttgtgtgtaatactctgtcatatcaaattcgattaattaaacaacctttatgggcatgaaccagccttggtctataacaatttgcaacttcaaagagacaaagtgattttcaaattactgcctaaaaatctatttaatatatataaataagcagaaaaaatatctatagtctttactggagaaccatgcagtagggtggggggagcatatggattttattttggcaagtgaagaaaaaagttattaagacatacaatacaataaaaaagaattcacaacatttagcaacagattggctgtgggtagcagaggctcatgaggagtcgacaacaactttctaagatattggcttagaaaacatgagtgggttgacttacatgttgttttctggagttgagaatgtttttactttgaagaacttttaacctcctctacaagactttttagctacgaggtccccttatcactatgagtaagagaggaatgcaattctgagcagatttctcctaaaactttatatagatagatagatagatagatagatagatagatagatagagatagatatagatatatatagatatagatatatacacatatacatatatatatatatatatatatacacacatatatatttttgagatggagtctcactctgttgcccaggctggagtgccgtggcacgatcttggctcactgcaacctccgcctcctgggttctagcgattctcctgcttcagcctcccaggtacctgggactacagtcgtgtgccaccatgcctggctaattttgtatttttagtagtgaaggagtttcaccatgttggccaggctggtctcgaactcctgatctcgggtgatccacctgcctcggcctcgcaaagtgctgggattacagacttgagccatcgtgcccggcctgtatttttaaaagttgtctttactgaagaggtctgttctaaacacgtattctgtgaggatttgattccatcattttcacacctgttactggcctgacatatcacaatgttttatgagaaaatagaaatgttatgaattcatttttaaattgtatatattgtacaaatttgtattaagcgaagccatggcaggatagcagtctattatttgccttctgtgcactgcagagttccagcagaggtggactttcctccagtttattagagaattttaaaatgtcaaacttcagtcaatagtttatgctgtttctagacctaatataacaaataataacctaatattgcaggtcattttcagaagcagtaaaatgctattatcctactaaaaatttttggagcacaatcacatgatatgaatttcttacacaagcatataagcaataaaaattttacagaatcttaagtgaggaaaaatttgaaaatgctaaaaaaaaaaacagcataaaaacagagatcagaaagtggctttgataattcaacatagaacagcctttagcttttgggctatggctctcaaaatatccaaaaccagttatttttggtgtgtgcgtgtgttttctgattctatttgctcccactcttccaacagcagtcccctgactcttccaatccctcagactcaaaatctttgagtcagtttcaagtattcgtccctttttgtcaattcccattaaatctgcttttgacacatctattcacttttatctttttctaagtgctatcatcctagtgtagggcttcatctccattttcttactaattattttttcaactttcaaagaatcctagaagtgtacacttattaaaatgcatttcatgctttggccctactttaaagcctatactgcattgatttgaatatacacttcggcagtcaacgtccctaaccatctgatcataagctaattattaaattggtatttgatattttaatggcacttgaaaatttcaaagtttccacagttattttattggattttctacaaaaccatctgtgccaggtagtttttattacctatctcttatccaagaggaatataagattctttgaaatttgacaacttacagactacaaatctagcaggtgttagctgtggaacttgaactcatatcctcagattctaaaacagtgtcttagtcacactacccccagtggcttccctctctatccaactctcactgtccagatcatgttccataaccagagttacagaacaattataattaccttccccatccaaaggcttactgtgccacagctcatttctagctgaaattatttcattttgagagatgaacttggacaattaattttggaaatatgaatgcaaaataacttagtaatttaacaacttcagattagtgtagggatagtttcaggagtaaattaaatgttgttgactaaggaagagaaagagaaataatgtgataaaaattattgaaaaggggtatacggtaagccttgtgagataaattctctctactcttgggcttattcgtggtagacatagagctcagaataggttttgtgagatgggaaggaggaattgtatgagctgttattgagagattaaaggttattctgggaagaatacatgtttcagaaacagcaaaaggtgggctcgattcctggttgtcactcattagtcacgtaaatttggttgtgttgtttaacctttctcaacctcagatttatcaataataaaatgggaataacaatatcaccctttctggttcctaaaatactgaacataatatatataaagagttttgtaagaaataggcactcatacataaaaaatggttttattctctaccagcatttgaccttgggcacattatttaacctctctgttcctcaatctacctcttctgtaaacatggggaaaataacagcacctacaccttgttggactgttgatgattcaaagagcagccgccatttgtgatacccttagaacagtgctcaataaatgatataaatgatgtgactaattgataaagacaaaagtcttgtgtttcccttagaaagatgatctaactatactgagactcaatttcctcatctgtaggattgggacagtaatttttcctttaatgttttgctttagtatttaatgagatacgtgacgtatttcatatgcaacaaaatgctattacaatgcaaagagttctggaatatcgaatatgttacaaaatttggggagaaattattagagtaatagagaatttttaacacctaggttggacatttaattcattgatagagttctaatttaaataagattaaaggtttaaaaatccttagttttgtctttaaattttgttatactatcttaaagtttgctaaaaaattgctgtgtctataagtttactagatcatcaccggcaggcaagaccaagattatcatctggatgagttctgtttgttagagatagtaaacacgtgatatctactcaacaccctttgagagaaactcacatttcctcttgataaatgaggtcagatattggtatcatatttaatgtcttcttcaaaagatcgcaatctaagatcactgaaggactttagaatccttgctggcttttgaataatagatttctaaacttaactttgccctgccaaatttatgtatttgttttaatggaatgtatttaagggttccatgtaccattgtgctatttttgcatgcccaggcatgctcggctgagaaggcaggtgaggactgaaatccagccctttgtaaaggcatccaagacacactcatgggattgtgtctgccctgaggaagtagagccttccttcacataaaggcagtgtccctgactaggctgtggccctggtagctgagtccaccctagaggacactttgcctctatttttcctaaacgcgttgctgatatccctcgacttacagtggggttatgttccaataaacccaccataatttgaaaatattataagtggaaaatgcatttaatatacctaatctaccaaacatcatagcttagactagcctaccttaatcatgctcagaacactgagattagcctatatttgggcaaaattatctaactcaaattctattttataataaagtgttgagtatcttttattcagtactgtacttaaagtgaaaaccagaatggttgtatggatacttgaagtgtggtttctactgaatgtgcactatttcataccattgcaaagtcaaaaaattgtaagtggaaccattgtaaatcggggattgtcattatatactttagaggtaggcctgaatgtgatatagataaaaaattgattgtatttttaaattgtatttaaaaattgaggtatgcaattcctcaaggatctagaaccagaaataccatttgacccagcaatcccattactgggtgtatactcaaaggattataaatcattctactataaagacacatgtacacgtatgtttattgcagcactattcccaagagcaaagacttagaaccaacccaaatgcccatcagtgatagactggataaagaaaatgtggcacatatacaccatggaatactacacagacattaaaaaagatgtgttcgtgtcctttgcaggaaaatggatgaagctggaaaccatcattctcatcagactaacacaggaacaggaaaacaaacaccgcatgttctcactcataagtgggagttgaacaatgagaacacatggacacagggaggagaacatcacacactggggcctgttggtgggtgaggggctatgggagggatagcattaggagaaatacctaatgtagatgatgagttgatgggtgcagcaagccaccatggcatgtgtatacctatgtaacaaacctgcatgttctgcacatgtatcccagaatttaaagtataataaaaaaaaaattgaggtctgcaacaggcaaagccactaaagaaactcagatatttttcattgtaatgttgaaaaagttatgaaatttcactaagcccgtgtctatgaagtgggaaaataacagtgatatgaatattatatgagaacatatttgtaaaatatttgttgtatgatagatacctagttttgaatgttagctatcatttttggctcttataataggttattggaaggtaggtgtgactcctatcttttaagcatgcagaatactgaagtgataaatttcatcattaattttcagacctttgacacttacttcggtgtttaaaaatattgatgtatgcagacagtttatctcctaaatatgagggaatgttatcatgatcactcaaaggatataccataactcatctgacatttaaaatgtcagtttgattgataaatgagagtcctgggtagatgaatgtgatttaaatggggtttggtttgcatacagaccaaataaataatgattcagttctgaagactggctagactagggctagggcaattaattggggtgctgggacatgatatctgagcaacagatgctaggttatgctgctttggtcaccaacaggcctgctccataacaggcaataggtacatagacctgacatttaagagcagttaatgtaggcctcaagaccttgaatggtaattaactaacatgaagaaatggaacagagtgtcaggattatctattatggcacaatttcctattctgagcatgcccagtggtgggtcagaggggaggtcaaggaacagatgggatcaggaagtaaagagagctctttccagctaggacaggcctgaggggaccgaatagacaatgcaaggcagagaatgagtcacaaggaacaaagaacctggcgaaaaccagagccacactaggtttctgatgaagctggccaccatgggcttctctcatttaagacactctctcaatccctcacgttcttcaggttggcatatgactgaacttaaaggctggagagctgcagcctacatgaggctagcaaataattaatgcattacagagcacttaaaatatgatacagaaatatacaattctgcatgtaaatccaagtattatgaaggaccaacacagaaatatataggcaataatattatgtgaggccataagataatgactttttattataataattatgcctgatctaaatgagctatgtttgatttctgtgtactttcatagctttatagccaagcatgacttctctgcccagaaaatcctgcctgatttactctttagcttctctctaatttactttctttttttgagatggagtttcactcttgtctcccaggctggagtgcaatggtgcgatctcagctcactgcaacctccacctcctgggtttaagcgattctcccgcctcagcctccagggtagctgggattacaggagtgtgccaccatgcctggctaatttttgtatttttagtagagatggggttttgccatgttaccctggctgtggtctccaaccctgacctcaggtgatccacccacctcagcctcccaaagtgctgggattacaggcgtgagccaccgctcctggccctactttacttttaccagctagggactgtttctcattcaatacatatatttgtttgtctgctaagttggatgtagtagttgagtagtggagttgaaaactgagagattgacagcagtcagttcattgaggattgtgttatcacgtgcactgggttagatagtgcaccctcaaaattcatgtcttttctggaacttcaaaaatgtggtttttgtttgcaaatggggtctttgcagatgtaattagttaagatgatgtcatattggagtggggtgggcctttaatctaacatggctgatgtccttataagaagaagagaagaaatacagagaagacacacagggagaatcccatatgacagaggctatcccgagtgacgtgtctataagccaaagaatggcaaggattgctggcaataccagaagctaagaaagaggcacggaacagactctctcctagagtattcagtgagagcatggccctgctaatactttgattttgaacttctagccaccagaactgggagacaatatgtttctcctaaaaaacaaacaaacaactacaaaccctacccagtttgtagtactttttaacagcagccgcaggaaactaatacatcatggaaatgaatttaaacatcttattatctataaagaatgtgaactgtcaaagcttactgttccattggacatcagtttcgtgtatcttttatcgtataatgcatgactagagtaataatttcaaaggacattaaaaaatacagacattttcttgaaggtacccaaacgtttgaattgtgggtcaggccaatatcagcaagggcatttgatagagtttctcacaataaccttctgtgcatgtaaataactgtatcttctcaatagatttgttattgtatatttggtcttgtagacttacccgaggaagtcagataatagcgtatttcgatatactgtgagaaaaataggtacacactaaataggagtatgaaaatacacaaagaattacccatcagcaagagcacattatatttgtttttcttgaaacacccattctttcctccttctactttgttttatttttaatctggctctcttgcttatcttcaaagttttatctcccccaataaatcttcctgccatggtgaaggttaaatgtaactcttccatcatccacgctagcacataccatatgcatagaagttataaagtccttgaagacagagactctattttacacatctttgaattcaaagccctaaaatatttgagccctgaagaagttgttaggacattttagccaccagtgcatactctagtagtgacggtagtgatgtaagtacattcctcagcttttctgaacattagtgaagaattccttttaataaagagcaagattttccattgatactcagatggacaagttttggagtattctcagagatgaaaaaggattatttttcatttgatgtacatgtattctgtgattttgtgaacacaatggatgcttgctcttttcattattattgttattcctttgggtaaggcctttatgttgtcaaaaacttctatttaaaaaaagtgaaaataataaaacattcagccatttgcagtcaattattcttgccactggttagtatatttatttaccagggttcttaattaatgttactgagaggctcaaagatctgaaaaacagcattggttccaagtggctgcatttctttcttattcatttatttattttttagaaatgaggtcttgctctgtcacttgggctgaagcgtggtggcgcgatctgctcactgaagcctcaaactcctgggctaaagtgatcctcctgtttcagcccatgcctggttaatttttttttttttctttgtagagatggcatctccctgtgttgcccaggctggtctcaaactctgggcctcaagtgatcttcccaccttggccttccaaaatgctaggagtacagatacgagccaccatgcccggctagctggctgcatttctttaaggcccagagcctcctgtggtagcatctggatttgaaatgctggctgggtgcagtggttcaaacctgcaatcccagcactttgggaggccaaagcaggtggatcacctgaggtcaggggttcaagaccagcctggccaacatggtgaaaccccatctctattaaaaatacaaaaattagctgggtgtggtggcgggcacctgtagttccagctactcaggaggccaaggcaggagaatcgcttgaatctgggaggcggaggttgcagtgagctgagattgagccactgcactccagcctgggtgacagagcaagactctgtctaaaaaaaaaaaaaaagagaaaggctcataaacattgtctatgtctaagctgcaacaatgattgatattgtgaagattattaatagtgtgggtcaactgaaggggaaggaaaacaccaaaggagaatttttccctcccaaatcataaaggcattcatttttcagagaagaagagaggaatattactttcattaaaagaataggaaaattaaaattgttgttattagccacaaatcagggtagagctgtgtgaatccatggggagaatgtaagattataagcagaaatcaaggttagttttgtcttgtacttctggaataagaaagatgatatgtaatcagaccatgtctctgataattttgttaaattagatgaagaaaatcacatggataagaaaatgtaattaaatcactaaaaataagaatgtcattgttttcactttcttttgctaagtaggaggtgaggaaaataaccttttactctgtacatgagtaattccaatatcctcttagaaatgacaattggattgtaaaatgggcttgcctttgaccatattctgaaaggataatataatgagttggcaaaagaccccatgaatagagtttatgtagaaagcaacaaaaaaacacaaatataaagaaatgcctacaaccaaaggtcagtataattgatagcaagatttcaaggggaaaaattagggtcagggaagatataaaatttctgtctccttgttttggtgatttttaatctagaaataaaacaggaatagtgaaatattccatagtatatctaaatatccatctttgtggcagggagctagaaagattcaggattattatttataaaccaatttagactaaattcaaagactgaggagatacacctaatttagaagaaacaggagctctgagacctgactttgcatattactactaatttttttcttagtgctcgttttgctgcccaggctggagtgcaatggtgcagtctctgctcactgcaacttccgcctcctgggctcaagcaattctcctgcctcagcctcctaagtagctgggattacaggcgcccaccaccacgcctggctaatttttgtatttttagtagagacagggtttcactgtgttgatcaggctggtctccatctcctgacctcaaatgatctgcctgcctcggcctcccaaagtgctgggattacaggcatgagccaccgtgcctggccagggcctttttaagtattattttttcttctaaagttactgatgctcaaatgaaacctaattttgaaaaatagaatgtttgaaagaaatagattgaatgaaaataacacagctgatatttttagcaagattcttggatatagctttagaaataaactagccagaaggagcagtatggcaagattaccttttctttatatcaattagacatattgtatcgtatgacttatttagtactgaagatgtctgtgcctttctgcagttgtttttcatctattaaaagagaaagatactatctatgctatcttttcaagatccctgtggatttgaattttcaagtgtatagataaaccttgattgatgaaaaattgatggacaaaattaattttataacaaaggtaaagaagtgagtattgccttcataatgtgccccacagcttttaacagaatttctttaaacaatatttaatgtatttttaaacaattatatatttcaatattaaatcttaagtatgtttcaggaatatcttctttaagataattgatatatcccagttttcatacgttttaaattttttacgtctacagtattatattttcttttgaaaaattgcgtaacattaaggtagtaaataaaaacaaaaatagtttaatgtctcttgtgggaaatacagttttgttttgttttgtttgtttgtttgttttgagaccgagtttcactcttgttgcccaggctggagtgcaatggcacgatctcggctctccgcaacctccacctcctgggttcaagtgattctcctgcctcagcctcccaagtagctgggattataggcaatgcactaccatgcccggctaactttgtatttttaatagaaacggggtttctccatgttggtcaggctggtcttaaactcccaaccttaggtgatccgcctgcctcggcctcccaaagttctgggattacaggcgtgagccaacgccccctgcctagttgtttttgaccacatattttttctctgaaatataaatgatttgtagcccaaaagtttaagtctgaatcaattgtctgtagtaaatgctgcaccatctacatttgttaatgagaacaatacagaactaacttgaaaactgctcaaattttcccttgcataatgctcagtttttaaaatgtattgccttctgtcttctcaatgggattgctgctttttaaattttcattaattcctaaaccatattccattgtattttttttgtacatttgctttaagtgactgtctattggaggaaaagaaagtgtaggttttctggtgaattataatagcaatatgattcctggaatgaagcagcttttctcgtttggaatgaccataaaatggcaatacacttaacagtaatacccttgtctgtgttacagcaatgggtcttaatggttttccatacgtgaacttagccgcttgcctacagagaattactaagtaactagtatattccacatgtaaaaatctccagagggcttccacacactttaatacacgctgatatacaatataaatgcaacgtatcctgaagaaaaaaaaaaatcacaaactccgtgtgtggctctcaacaagctactattttctcattagaaaaataggaaagctggccaggtacagtggctcacacttgtaatcccagcattttgggaggccaaggcaggcagattacctcaggtgaagggttcaagaccagcctggccaacaaggtgaaaccccttctctactaaaaatacaaaaaaaaattagccagtcttggtggtgggtccctgtaatcccagctacctgggaggctgaggcaggagaatcacttgaacctgggaggcagaggttgcagtgagccaagattgggccactgcactccatcctgggcgacagagggagactctatctaataataataataataataataataatagtaaagctaataactatacaatatcttacctaaatgtttaagaacacctactaataatacttaaaaataccaaaatataaaaacaaaacatacaaatgtaaagaacatacagtcagtagtacagcaaatctatttgattacttttttcaaaattctattttaatttttttgctaattttaaagcactgttattaaaagaaaatattttcaattggttttattctcattgtatcttctagaaatactagttcattttaggaaaataaaaatagtgagagaaaacttttagctctgaatatggaccatgtcccatgcctgccactttgttctagtttttgttatttaattatcacacactataaaggagttcttaccaattcttttttttcttcagaaataattgattcttcagttttttaaactgctttattgaggtatgattggcatatacaccaattctcttttataggcaatgaaattggagatcagaaaaaattgagtaacttacctaagactacaagtaagtggcagagctagaatttgaccccagacaggcttcacatacaagttcacagggccatcagctgcctgaaggcagagaccatgatttgtatccatagtatttatgtatctctcatatctaaataaaatctagtcactattcagatttaattgatattttcaattacctttgtatttttaaaagaagacacattatagaaatttgatactaaatgtaagtattcagttctttagttaaattgaagaaaagcagaaataatattctgtattaatacattagtgaaaagtcagcagctaaaatgtaagagatgtttggtgacacaagtaaaaatggattgtatactttttgccttatactacctgactctggcatttagatataacttgttccagagacctgtcataacttatatgtttcagacaagaaaagctttgggttacctgaaatagtgtagttaaaaatcaaacgctgtactcatctagagggactttgtttatccattcaaaaatacatgaacagggctttatcttggcctatttgaactccatgccagagggcagcataacatagcaaagcatgctgacctctccttatcactgcccttgttgaaaaccttgagttcttcttaatagtctggtatatagttttaaaatgttgatattttgttcacagctatatgtgatctcctaaacctttgcttcaaaatagtctatttctctgttgtggtttgcttcagggtaaaagccctctgatttcccacaatcaggacagtaatttggtaggttaataagttatgttgtgtgttagtgaaatataagtgctaaggaaaataaaagtagtagggcaagggaaatcaggaatactagggcctggaaaagagcatgaaataatgtgttatgatgagttgcactgagcaggttaaatcagaacgagacaagaagccaactagatagagaagattgttccaggttaagggaatgagtggaaaaaaggctctcaggtgagagtgtgttcaaggaatagcaattaagactgtgactactggccaggcgcagtggctcccacctgtaatcccagcatttttgggaggccgaggcgggcggatcacttgaggtcaggagttcgagaccaacctggccagtatggcgaaaccccaactctactaaacatacaaagattagccgggcgtggtggtgcacatctgtaatcccagctactcaggaggctgaggcaggagaatcccttgaaactgaaggcagaggttgcagtgagccgagatcacgccactgcactccagcctgggcaacagagtgagactccctctcaaaaaaaaaaaaaaaaaaaagactgacttttataaggaagaaagtagtaagagatcataaaatcaagaggatttggtggtacagattagagacttgtacgttttcgtttctgtgcagtagagaaagaacacagagacatttgcaaaacaatttaagaggggattccttcaatacttttctaatatccctctcccaaaggcctgtttattcttcagctaatttttactgataatttgtattttttagaaagaacgcatctctttattttatagtcatgtatcatcaaattatgtagtatataattatattagatcattacatgagcaggaatgggaacaatcacagttgattcttgctatgttccggttatctattgctgagtaacaatttattataaaacttaatagcttaaaacaccagtcactttttatagctcatgattttgtgggtcataaatttgagcgtgggtcaactgggtgattttccactctatgtggtatcaacttgatccctaaatgatactcagctggcagatgagctggtcagcagaatccaagacagctgtactcatatgtatgttgctttggtggagacgacagggagacttgggtcaactagatctattgactctagtacctacatgtggcctcttcagcatggtagacccaggattgttgaacttatcacatgggagctcagggttctagagtgaatgatacaaaagacggaaaatataagtttctggtatcttcaggcctaaccctggaaactagaacagcagctctttcactgcaggggtccccaacccctgggccacacaccggtacccatctgtggcctgtgaggaacccagctgcacagcaggaggcgagcggtgagccagtgaagcttcatctgtatttacagccacttcccattgctggcattactgcctgaaccctgcctcctgtcagatcagcaatggctttagagtctcaggagcacaaccctattgtgaactgcacatgtgagagatctaggtcgcatactctttatgaggagtatcaggcaatctagtgactgatgatgtgtcactgtctcccgtcatgcccagatgggaccgtctagttgcaggaaagaaagctcagggctcccactgattctatgatatggtgagttacataattattttattatataatacaatgtaataataataatagaaataaagtgcatgataaatgaaatagtctccaattatcttaacactatccctcacctcccccccactaaccccagtctgtgggaaaattgtcatccatcaaaccccagtctctggtgccaaaaaggctggggaccactattctactgcattctattagagcagccacagaacccacccaaattcaagggaggaaacaaagactttacctccccagtgaagaaatgtcaaaaaaattcgcagctatctttaatccgccaaagcatacgatttatctctcatagagagatttctagttaaggtttttcagcaggtcatcttgatccatagtaaatctaacaaagggaatggagagctttggttaatctaatgattcagttaaatggagatccattaaaatagattctactataattccattcattatttttcacattttttctaattttttattattcatagtgtttttgtccaatgacctttaaaatcatgaacatttaatatataggaatggcatccatctgaatatggcataattataaatgaatttactttaatatctagaaaacattcttgttcgttctctaacttttagataaaagccatcccttcttttatttaatttaactctactttaaggctttaaaaacctgactgatagggaaaaagtccaaaactgggacgctcgtgtagactatttactgcaataaatcattgtgaaaaatatgggcagtcaagtgctggatattctatttctgtttgaaccctaagaaatatcaaccgtcttctcactggcttttagcacatctgctccatttaaaactatggcagggaggtgtgtaagattgaattgattgtctcttggagtttactgtgcttctttcgaaactttgtttttcagtaaaggcaattgcttcttgagcagtactggttattccacacccactaattatcatgcagccatttagagttgaaatggtaatcaaaccaatgaaagcccaagattagcagcgttccttcttcatttctggtagagagattcatctgaatatctataaaggattttgtggtgcattctctggcagatgcagtaaaacaagtgcaacatgaactttaaaatacagctttgagttttaggttgaattttaagttgaacatatttcaaattttgcaatttaattataggagttaaatgatcttaaaggatcattctaggtctgaatagaattttaagagctagattttattaaagaaaagatatattttaagtgataaaatttatatattttgcccttcagaaattactggttgatgtttctattaaaattattaagatctaaatatacaatgatactcgagaccaattctcatttaaggaatggcatactgtatgacaggatgtgaggtgttaagagataattacatgcctagaaggtgtagtgaatcatatgaccaaaagccaagaacatccagagaccaaaattcacagtcatttcaaatatcattactccctggtgtgtgttattctacttagaaaattgcatgtttgttgtttgtaaatttagagacaaaaaatgcttaaattaattttttcatcatttctaaaaatttgctttaatatttactagcccagtaaaatgtattcaaatcataattataaatatcagggctattgagcaggggaatgtgtcaactgccattccggaccttcttctggaactaattttgattgccagcagaataaaatgcatgcaatgaatacaatgaatgtaatgctaaatcaaataatcaagtgtttatgtttatgtattttgatccccctatacatttaaaataactctgttttattagaagttctgtatttgagataaaatgcacctccctctcatttttcctggtttgtatgtgagaccacagtatttcacagtagatatccagggaaataacagacaaaagaaaggagagcaggaagaatattttaagatttattggccagcggcggtggttcacgcctgtaatcccagcactttgggaggctgaggcgggtggatcacaaggtcaggatgtcgagaccatcctggctgacacggtgaaaccccgtctctactaaaaaataaaaaaattagccaggtgtagtagcacacacctgtagtcccagctactcgggaggctgaggcaggagaatcgcttgaacctgggaggcggaggttgcagtgagcagagattgagccactgcactgcagcctgggtgacagagcaagactcgtctcaaaaagaaaaaaaaaagatttattaatttgtcttcaacaaaatactaactctgcagtgccctcaccttgattccttacttattgaggactaagcctatttttgtggattgaaatgatgttaattatctgcatccaaatacccctcataggggcgactgtgagcacgtccctctactagtaacacaatactcaggtgagagctggcaaacacaggaagactgaaaagcccgacttggaatcctgacttctacattttttaactgtgtagttctgggagtttcttaaactcgtgtgcctcagtttttccatttgcatctgtagaaagattgtaatagaaactaccttctctgttataatgattatatgagctaaagcatgaagaaatataaagcagctaaccctgagttagctctcaagaagtattttattattaacttgttaataccttcaacttataaaaatttaaaaattatgaaattttttaaattatgagatttacataaagttttcagaatagtctaatcaatacagacagaaagtagattagtagggcctggggacgtggagaaaggagagtgattcctaatgagtatggggtttcttttttgggctgacgaaaatgttttatattagaaagtggtaacagttggccaggcgcagtggctcacacctgtaatcccagcactttgggaggccaaggcaggtggatcacgaggttaggagatcaagaccatcctggccaatatggtgaaatcccgtctctactgaaaatatatatttaaaaaaaatgagctgggtgtggtagtgcgcacctgtagtcctagctgctcgggagactgaggcaggagaattgcttgaacccaggaggtggaggttgcagtgagccaagatcgcgccgctgcactccagcctggcgacagagcgagactctgtctcaaaaaaataaataaataaaggaaaaaagaaagtggtgacagttgcataactatgtgaatatactatatatcactgaattgtgcactttaaaagagtgaattttgtggtgtgtgagttatagctcaataaaatgattttaaaaaataaaatgagaaggatgagagaccggtatatttcagaatagtgcacttaaaaaatttgtttacagaacactaattgttcagcatactttctactggacattactgtatatatatatatatttagtattatataaatacattatatgataaccatatctgataaatattatcttactttatagatgatgaaactcagatcttcaatgatggaagtgacttatctattgttgagttgtaattggatcttatatatatttccctgctcccacagagcctacatttctgaaaaagaaattatgtctcttgtgataaataaacaagaaacatatcagataaaagtgttgcattgagaacaaactgagttgagatagtgagtgattgggtagttattccagcttcagtagtaaagagaatctttgctgaagaggcatgtcagctgagatatgactgtctagaggaaccagtcatgtaaaaactgaggaagaaccttccagaaggaaagaatagccagtgctaagacactgaatttcttatattttgtgtttagaaatgctagggttatagttagcaagatagcctggaaggagccttcccatgttttctcatatatgaaataactaacatggaggattattgtgaagttacaaaaatacatgaataacacctagtatagtatctcactcgtggttggtatataaaaaatattgctgttctattaattcctcaatatatagctattctatacaggtcttatgcaaaaaagaaccttagtgaacgtatttcaacttggtaagagttagttacacatgggctgacacaatcataagcatggaaaatagacaatagattgaaagcattaacaatggtagttggaacttcagaaaaacccactctttcttaatctatgatgaaggaaatggtgggttttccagtggtattgaaataaaaggaaactttttagatggtggagtaaggtatgcaaaggtagcgagcgtgtgcatctatggctggagagaaatccaaagacaagatagaatcacccttttgctctctgtgaaaactctgattttcctttcatggactaaggtctacactctccaatcatcttagttgcatacactattaattcatcaatcaagctacgtcatcctttgtgatatgttttgtttttctttcttctttttaattattgtgggtacgtaagagttgtacatatttatgaaatacatgtgatattttgatacaggcatacaatctgtaataatcaaatcaggataattggaatattcattacctcaaacatttatcatttatttgtgttgggaacattccaagtctactcctccagttaatttgaaataaacaattaattattgttaactataatcaccctattgtggtacagaacactagattttattcctactagctaactgtatttttatactcattaaacaagcccctcttcatcaccccctccccactacccttcccagcctctggtaacaatcattccactttctacctccatgagatcaattttttagctcccacatacgcgtgagaacatgcaatatttgtctttctaggttgtgttttgattagacaacctcttatttctaaaatttgcttaaattatttgagtacttgatccttcacattactgccaataaagcaaaccacagttgaaacttgatttttttctaatattttgaatgtatgctgtgtgcaaaggtaacaaagaggaatccatttaacagaaaacagattgctaatatcttcatcatttactttagattccagtctttggatatcagatttttctctggtcttcatatttatttgttttggcatcagattgcattttcttgcttggtttaaaaaaaactgtatttttttccctgtattatcggtgttgatttcctctgttcttattcttcaaattatgcagagaaatgtgtacaaagttaggaggagttaacgctatataaaataaactatctattaatatcattcggttaattttcaaagaggctgtaaatagatcatggatataggcaaataccagatgccacataaaaggaaaacctcaaagacattttttcttttattaaaaccatcaacagtaagaactgtgacagtaggttttgggtttttttattgccaaggttattatcagccctctaccctaaataagggaataaaatgatttctagtttttggacactgtgttatattattctgtaactacaggaacataatataatgctacagtcaaaagaataagcttagaaatcatctaagtttaaatttgtcactcattttctagaaggatgaccttatactatctatttaacctttctaagactcaattgccttataaataaaatgattataataaagacttcataagttgccatgagaaaagtattaagcacagtttctgagataaccaatattgataataatataataatcatcacaaaacattacctttctccttgtaaaaattataacgttaatggttttaaaaatgtaattctagtaccaaagtgaagtttgtattatgttctagttaatatatataaaaatttaaagaaaaactaaaatacatatagctgtgaaaatactcactaaaccaacatagaaaagcatttgttttgctctgtaaatctaaccttgatgattatgataataaaaataatcactgttaggttattttacttgtgattaacttctatttatgtaccctccctctattgatgtttaacaatagttcatagctatgactatttcatttcatatggctgttcctaaaatcatactgaacatctgactccatattcttaagacaacttgggacctctatctcttccctgcaacaatatttgtgagttgacaaacataaaagcctatgctttagcacgcacaagagatgtggaaaggtaccatttaaattagtaccataaattttcctttttatgtttcctaacctcatatttattgaaatgcattaaattaactcagacatctaaggatataacatttaatttacaataatctttatggttacttaattccattaaccttatctttgaaaggcgtcaaattaagaaatacagagcctgtcactttcatttattcgggggaggctgtgaactattcagatgatgtatctttgattgagggaaggaggtgcccaagaattagtcaattacgcaattaaaaaccccaaacctttcctttggtatgtttcacacaaaatctccattgctgtgctagattacactggatgatgaatcactacttgaatcacttcagttttgattattcaaagtaaaaattgaatggttggcattttcaccaatttaaaagcctcgccgggcacagcggctcacgcctgtaatcccagtactttgggaggccaaggcgggtggatcacctgaggtcaggagttccagaccagcctgatcaacatggtgaaaccctttctctactaaaaacgcaaaattagccgagcatggtggcacatgcctgtaatcccagctacttgggaggctgagacaggagaactgcttgaagctgggaggcggaggttgcagtgagcggagattgtgccattgcactccagcctgggcaacaagagtgaaactccatctcaaaaaataaaataaaataaaagccttaactttcattttctcaccagattttagcttgacaaaagctatctttaagggttgcttaggcatttcagtttgaaatgtttatgttcttgctataaaatgtgtggacatgtgtgtccaaatatatacacacaagaaattttaggtactgtcatagtgttgggatcattaagaattgtgttttcatggcgagtaaattaatttcctctgctgtgagtcactttttggtagtgtatgcatggtttaaatgaaactcactgaactgtttttgtggattcactgcttggttgttttactaccctagagagcaattaggtgtatgtggagtgtgttgaacctataaaattttacttgtgtgatgactgcaaagaaaatgaaagtagtgtcatgcaatccatgaaaactctgctgagtttctagctagtctcttaataaagtttacacaattcaaactctccaatcatactgaatatcactgaggctcttaagacttgtgaaaatcagatattttaaatttttaaattgtcatattatgtcgccaatttccatttctactctatatttatagtacttttttgcattttgagtgcacaagtcaacccgtttggccatacatagcaagacatgtattggtgagagcagcaaaaaatatgtaactgctcgtttacaacttttgaccagtagcgaggtcacactgagagtaccgctcaggagaattgagtcaagttttaggctactaaaatttgctgagctctgtgacctagggacatattcctgactccagcaggcctttgaagaaatcacgctggcaacctcacaatagatgaacaagaaaatggatgaacacaaccatattataagaagcagttatcagacgcatgggttctggagccaggctgtttgctgagttcgaatctcagtgctgctatttaatgactgtgaccttaggcaagttgcttaactctgcctctcttaattttggaaattaggaaaagaactacttacattttaggtttgttggaaagatttatatcacttaaaatgtatacagcatgtaacaattattgaattatacttaacaattattatctaggggaaaatatactgatgattttgtatattgtatatatatacacacacgtatatatcagtaactttaaatggggaagtcactaaaaaaatcataacttggtgtaaatatacttaatctgtatgccacggctagttttttgtttgtttatttttgccaagtttctttaatttctgttggccttttggggtcaccccattagcatctgcaggatagcttacttatacaggggaaagtgtctgttaccagtacagtacagtggtggtataaggaaaatctattaaatgaagtcctgggtgtttatccctataattgcataaatgtatgtttctcaggagtagtgttgtgtaagtaaatggataaaagtcatagagtgctaaagctaaatggaaacaaagttatttagtccaattcccatattttatagatgagaaaactgagaatcagaaaatggagggatttgttcaaggtcatagtagttattgtctgagatgaggaaaatatccaaatgtctgcttaaatactgagatatgcttaagttagcgttgaaaatattccatttaaaatagcaatattttcttcctcctgaacatctttgtactatttagaaaaacctagaaagcatgctggaaaactatccctttttcccttgtcaacctccaattaacacaaaagcccaaactgtacactgtcccttataaaaacaacctaaaattttgagaataacattcataatcttaaaagaaaattacctacttactacatatgctggcaatgtacttgctgggcaatcccacttgaaattcatagaaattaaacagcatttcagaacatcattccaacacctaattaatgacagggagtgactgctgactaaagaatgtgtccatgatactttcaatttatagcaaaaactcttaactattgatagcagaaatgtgatatataaggatcttgttctgtcctttcaaaagtcaaacagaaccactgtcccttaaagctgatcggcaaaggaagaagctgggagtccaaaggatttatttatacaaaatatgtatttccctaatgttcactttccaactttgattagacattttttttttttttttttttttttttttagcgatggggctgtattagtcaattctcacactgccataaagaaatacgcaagatgaggtaatttttaaagaaaagagtaattggctcaaagttccataggctgtacaggaagcataatgctggcatcttctcggcttctgggaaagcctcaggaagctcaaaatcatggtggaaatgaagggggagcaagcatgtcatgtggccagggcaggaacatgagagagagagtgggaggtgtcaaacacttttaagcaaccgtatctcatgagaatacactcaccatctgaagacagcaccaatgggatgatgataaaccactcgtgagaaatccacccgcatgctccgatcacctcccaccaggccccaccttcaacactgggaataacttaaccgggcgtgatggcaggtgcctgtaatctcagctacttgggagacagacgttgcagtgagctgagatcgttccactgcactccagcctgggtgacaagagtgaaattccgtctcaaaaacaaacaaacaaacattggggattacatttcaatatgagattatggcagggacaaatattcaaactatatcaggggtctcgctctgtctcccaggcttcagtggcaccatcgtaactcactgcagcctggaactcctgtattccggcgatcctcccacctcagcttccccagtagctaggactacagttgcgccaccacatctggctcatttttgtagaaatggggtctccttatgttgcctgctttggtctcaaactcctggccttaagtgatccgcccatctcggcctctcggagtgctgggattacagacgtgagtcactttgccctcccggactggttttatgtgtgaaggaggctgctgctgatttcatgagtaagctggagaaacacattaaggaatgatactgtccccttagttgtcaaccttcaaaataggaaacaaataatagcaaagaggtaaacgtggcagaaagcaggggtgagaaagggaacaatcagatatgcgaaacatcaaagaacaagaaatagcaacaaacccacgccagaagccagcaagaaaaggagaactgttataagtaccagtaaaaatgctgaagaatggcaataaaaaggagaaaaaagtactcacaagggaggccttgaaatgacaataatctattccaggatgaaaagaaaaggaaacactactccaaggcaaaaagaaaataaaaagtaaggaaaatcaagatagatgaatatcttcaaaaaatcagcacaatggagatagagtgtttagggaataagaaaaaaaataaaagtagacagatacagaaagaagtagcaaatgcaaggagcaatatccctattattaatgctggcaaattgtacttatatctctttccagctatatagcatgttcctgggaaatagcctaaagcactgagaattagggataggagaatgctgttactgtgagaatacgaattaagtaatgccagagaaaggctttgctgccaatataatagctgagtgatcaggccacgtcatttctgtctgatgtttcttcctgtcgaataggtaatagtattatttctctaactcaagggacattaaaaaaatattcagttaatgtatatataaatggagacaatatagacagatgtttaagaatattttggttaaaaggacagactcaaagccaaactttctgggttggaaatccaactctttcattttctctcagtactgtactgtaggactctctttttatacactttttttgtactgtcttttttatacactgactctcttttttccttagtttcttcatctgaaaaatagagttaataatagcacctacctcataggattgctgagatgagaaaattaacaaataaaaatcacttagaccagtacctatcacatagcaaggaaaatctcaactatattcattgtggtgatgttttgttaataaacttttaatatgaatgtaacatatcacattcattaatatataggaattatatttacttacattgataaaagtcctatctgacatcatcttctgttccttcattatttttcccttcttcctcactttttcagttctgtctctcttggttcattccaaaaaagggtcatttcttttttgcctcaactgcagaatgcatattatttatcaagcaattattgagcacttaccatatacaggcactgttagaaagacatctaaggcacaattttttagtgtgctgaaatagttattcattcagcaaaagaaggagctcataaaaataaaaaagaaatgctatgggtaaatataagaacatggtgatttcacttggtcctcttggatgtaaaaggaagctttaccaaaaatgttaaaataataattgatggttgcagtgctgctgaattacatcaaactttctattgtctcacatttcactttctaatttgtccgttcctagtgaaactagaagctgaaaccacatttttactcatttctcccgttatcctccccccaccactataaaaagagaacatttatgcttaagtgcttctgatgatgtgttctcagtatctcattctgttagactaatagtcctcatgccaagttaaagtggttggaaatcctagcacaccttgcctaagtgtgttttatttatcttgctacaccccgttttattgtaatagtcttgggagagccccgaaagatggcattgacctatttctataaactttaagggagcaggggacgatctccctccataacaaattccaataaatgatgaggttaaaaattatagaaaggatatttctagagaggtatttttatgtgataaattttaatatatatgtatatagtttttaaacttgaatatataaaatatatactaaacttgtatatttatatatgtattaaacttgtaccacttaaaaattcttctgtagaaatatcttttctataatttttaacctcatcatatataatgatggtaattcttcgtacttcttactcctaattgtcttagttcaattgggctgctataataaaaatatcatagactgtgtaatttataaacaacgaagatttattgctgcagaactgtttctgcagcccaggaaatccaagatcaaaatgttggcagatttggtgtctggtgagggttctgtctgcttcacagatggtgccttcttcctttaccctcacatactggaagggcaaacaagttcccttggcctcttttataagggcactaatcccattcatgagggctccgcttatatgacctaatcaccttcttaaaaccctacctcttaatactgtggcattggggattatgtttctacatatgaattttggagggacacaaatattcaacccatagcactaatgaaatacagcatttttagagagcaatgtctactattttacaggcagcttgctactcgtgatgacaatacttcttcgatctagtatcccagcattgttccattaacaatgtatgcatcttaccaatgtaatgttcagtaaatattttgcatattttaagaggaatctgttgtggttttttttttttttttttttttttttttgagacggggtctcactctgccacccaggctgaagtgcattggcttaatcacagctcactgcagccttgccctcccagaccacaggtgcgtgccaccacgcctggctgatttaaaaaagaaattatttgtagagacaaggtctcactacgttgctcaggctggtcttgaacttctgggctcaaccacccctctggccttggccttccaaagtgctgggattacaggcatgagccaccaaacccagcctgattttttataatacaaaataatatacactcactgccaaaagtagaatacagaaaaacacaataaaggtaatagttgcctataattttgctattcaggaataaccagtgttacctgtttggcacagacattcctattgagaactatataatgatagctaatatttactagcacttggtacatacccatgtttcaattaccttatatgttaaatattatccatttatgcctgaaaataattttataatataagtactgttattagaccattttaaaaatgtgaaaattggtgcaataacaagatgcattaacttgttcagggtcacaatgccattataaaatggagccggaattctaaaccaggcattcaggctccagagcctaggtttttaaccactaagaataatacattttagtattttagcatacacatagttttggaagctgcttaattcacttaatatatcatatggttttccaacgtagttaaatattccataagaatgtgatttttttatgtctgcatataaatatattaataggatgtaccagaattgttttcatttctatttcatgaatatttagtttgcttctaatttttcacaatagaaatgatctagcatattttataaaatttttgagcagatgtacaagtatttagagactagtatttgtttaaataacacgtgttggacgttagtggggtatatatcaatgtgaaacatgaagtagatgtttgctttgtggtaactatgttccaggaacagtgctaggaagcactagggactggaaagctgtaaaaaagccagtctttctgttcttaaatatcttataatctaatggagagagaaacctgtagaatagtgcgtttcagtagaagcaagcttagtgtactgagaaatgaaaggcagatgatgaagtttggacaatggatggaaactatcttatcaagagttggggttataagaatgacagtaggtgatatgaagaaactagtgttttaagaagatatatgtggcagcattatagacatatggggatttagaacaggattatacctactgaactggacttattttatttctagaaattttgtgataataaataccatacattatatgttgttctcatataggagacgtaatatatgggtatgccattaatcaaaggctgattttaagtggaagaattcgttctgttggtttacagtcccagttataaattaatgggcttaccacgtagttgttcccagatcttggaagtattgaagttttttaaaaattaattaatttatttttaactgacaaataatagttgtacatatttaccgagtacaacgtgatgtttttgatctatgtgtatgttgtagaaagagtcagtcgagctgactaacatatctatcacctcaccaacttatcattttttgtagcgagaacattaaaaaatctattcttttagcaattttgaaacctataatacattatttttaactgtggtcactgtgaggtgttgaatgttttaggaaattctcagataatctcagggccaagtgttaagcagatcattctctgagactggatcttctgcagtatgtctgcgaacttttttatttcactctaagcctttgttgttgccttcaggggttactgactcacgtttaactcaaggctgactgagttagatatataccgcctatagttgatgggttttgttgccagaaatattcttttgcttatcagtggggaaggtttttgcttctactgctggatttaaaggtgtccctcaagattccattactcagttcattgagaaaagcttaaagctaacggaggggagttctgagctctgtttgatgaaggaggctgggtaaaataatagctcccaagttggctcaagttcttccagatgttcatgtttatgtaaaacttaacacttagagatattccatgttgtaagatgtctgtgcaaaagttccttatatcaaattctaaaatgatttttggtcatcaggtgcaaaaattaacactaatcatctaaaataaccaaccagatagattttcattctgtttgacttttgaaagcaaatacccctatgatattgagtgagtgttttattgtttgattttccttcaaacttgctgtaaccctatgggaaagatatgcaatcaaaataaaagaacagtatccaaaaataaatgggtcatgaagaattgtgcttaaaatcgttaagtaaacagacacacaccacagtgatgagattgtagaaactggaaaaaatgctgccagctgaagagctgcaaagagtttggcttttcatgaacttagttactgaaatgaaagttcctccctaggagagaagccaaaatcatagcacggtttgaataaaagtacacctttccaaagttactgcagaacaattatggccgggatcctttactcttattgagaaagctcggtaacctcttattttaaattgacttccattgagcaataatgcctccctgcttgcactgtaaggtactttattgggtaatgtgtttacaagctggtctcatttttctttttgtaataggagatgggtagcttactgctatttggaggtgactccaggaaacatgattttcaagatggtcattttaaaaaattgtgattattgggaataataactctagagacaagatttaatggacttacttccaatttattcagtatgtcaccaggttattgcagttctagttttaaatctgtacattcgaagtctacgttgttccctgatgtactgtatatttaggtttgtactactacatataggtgctaggtttagctccaactctcagcaggagcctaacctctcagaacaattattgtagccagatctttggtggccctactacttgctttttttttaaccactactatttctttaaaatcaaagatatggcaaacatattactaaaaggaagaaaacccatcttcaacaacattatggtgtttttcacttcaaaggcttattttgtatgcatcatttgatttaatttcctccaaagccttgggaaatgtgagtgattatcatcttattattgttgttgataaatagtagctactatttatttagcactaactctgtatctggaactgtggtaaacaccttgtagtggaaactaacaatagcctcaggaggctggaattgatattatccccattttacagacaacgaaatgtgatataaataacataacgtgccaagattatgcagctagtacataggagaactggaattcaagccctagttaaattgctttgacttcggagcctgagtgttgattgtctatggcatgttgccaagctattttatagctggaaagcctggtgatgctaaaagtttaaataccttgccctaggtcataaaattagttcccaatgccttccaactgaaatcccaaacattttttattacactttgttgtccgcaggactgctacccgcttatatggtactctttgaaaattaaacaaagaggcatcctccccacttcccaaatccacagaatagccaattttgaaagaaagcacgcttttttttcagtatgactctgctttattggaggatcacagggatggctggggggaatgtgggtatgatactcaagcacctttgtgcaaggtgcaatgcccagagccataaggagtggccccagttgtgctcatttaaaggaatagttggacaattctagataatattaagggagatatccaaaagagtttcctataagtatgtgctcttaagagctgtaaggaagtaaaattttgaccccattagttacatttctaacatgatctaacatcttcccttcactgccaacgaaaatgtttaagaagatataatctgacagcagttatgctaaaactcccctgaagccaaaatgtgtcacttctcaaaatgaccctcatcttcacaagcccttgaagaggagttgaggattatttatgaactaggttttaacctaaggtgatacattgtgctgcagttgttactgagcttagggatcattttgtctattcatttcaggttaccattaggttctttttcaaaatcaattccttttaattatacagctaccctgggcatatattaaatgtcttacaacattgatacgctttcccctgaagtactgacaaagtaatagatttaatgcgcaaccacaggcataaaaacccacacacagtgtaagcatacaatgagtacactgatactcacaaaagaggtttaaaaaaatgtctgtaactggggatgtggtggtgtgagggccccatgaatttttagcttggaggatatcttatcgtaccgatgaaccctgaggatatgcatgaaaacaagctcctactcacaactttttttgcctgaatggtaagtttgtctgcagggcttggtctgattgatttgaaggagcatggtctagaaagtggttctcaaactgttggataacagaatcacctggggggtctacctaaatgtgcaaaggcctaagtcttatcactgctttaatgaatgtaggtctctgggtttataatgagctcgtcagttgattctgatgagcacctaatttgataacaacatgtcaatgggtacagattctcaaacttggctgttcattagaattgcttgagtctcatttctagagactctgatttcattgatatgaagtgcagtttgggcactgggtttttttcttaaagaagttcttcaggggattctaatatcagcaaagttggagaaccacgggtctaggggcctcgctacccgatgtgttgtccaaagaccaccagcagcagcagcagccgcagcagccccagggaacttattggaaatgcagaatctcaggtcccacctaaaattaccgaatcagaacccgtattttaccaagatacccaggtggtttgtatgcccattaactcttgacacacacttgtttagggagtcaggtagagctggattcttaagcacttccggttagttggatgactgaaaaacctctctgagctccaatctcctcacctgtaaaacgagtttaaggaataacattaccaatattgcaggtttgctgagaagattcttgaatgcaatacctgaaactcagtttaattcctagaacagtgaaaagcctcattaaatatgaagtcccggccaggcgctgtggctcacgcctgtaatcccagcactttgggaggccgaggcaggcggatcacctgaggtcgggagtccgagaccagcctgaccaacatggagaaaccccgtctctactaaaaatacaaaattagctgggcgtggtggcgcatggtagtcccagctgctccggaggctgaggcaggagaatcgcttgaacccgggaggcagaggttgcggtgagccgagatcacgccattgcactccaacctgggcaacaagagcaaaactccgtcatatatatatatatttatatatatatatagtccctactagaagagagtccctgtgaacctttttttacactagtggccccagagctaatgaggccaagccccaccaatgatcgtcgtcacagacattcctgtttttctgatatttataaaggttccttttaggtatgaggtgatttttattcaaaagaacaaatgttcccagatgccaagtgtcttccgctaaaaggataaatgatcagaaagcaatccttagctacagtgtccttgaaggtgcattgtggaatcttgcactgttgtgcaattgtgaacaacttcatcagacagtactgcgtatttgtactgtgttatccttaatttttccctttagatcttaatttgttatttatttcttccctggccaagagctaatttctttacagaaactcatatatagggttccttttttcctcctcaagtcagtaacttctgcaattaactacttttttcttaatttctctaactttggcccaactaaatattttcccatcattcctgttttgccgccctcgagctaggacatggaacttacttgttcggaaaagcttctatctgattgaaagggcatgctaattctttctttatagtgtaattgtttcacatttaagagggaaggagaaacgcctaaagtaataccacagaagaaataccctcaactaatctttctaagcagtacgacaatgagtaatgattacagttaattaagttaggcaacctccatttccattcacttagtagcactgctaattatactcatgctacaaggtttctttagttcttctgtaatttggatgcagtactctttgtagacaagggaatacggtacgattaatgagatttttcccaccaacacctcctgttctctccaaatgaaatttccgcatctgaaaattgagagtagggaacggagaaaaaaaaaatcagtcacattttaacttactgccagcacggtccatgcttataattgccaaatattttatattaaagaaaacaaggtgtgggtttttttttttgtttgaaaccttgtaaaattgtggcttacgtaaaaatgaaataagtatagaacatggctttttaaaaatatcagtggcaatgataatgacactttatattgtatgcttttggtcgcattaaataaacatatgttgagcacatactgtttgccgggcactggatctactaaaaaaaaaaaaaaaaaaaaaaaaaaaaaaagcaaaccttaactgtaactctggatttcttttacatgaacttcaatcattttaacaacttactctaaagaaaaccaagaactgcagctctacttggttatattgttaatgaagtccttggaaaaatttagtttatatgctttgatcagatggggattgacatacttaagagttttatttttaatctgaaaatccacttcaatcttatgctctgggtaaacagtcattacagaagcctgacacaattctgttttttcaagaagcaggattcaaggtttaacttcaaatacaaatttgagtaagttatacggattattccttttaattctttttttaaaacacagggtttatgtggatgaagtttcgttcttaatctccatttgccttaagaattaacttctgcattgtggtttagattgagtttaagattgtttcagattttaaaatgtatttttaaaggtgtgtctggaggaagatatttgtatgtcaagcactgttggttttcataggaagttcaaatgtgttttcagcagcactggacgtttttagagttattttcttctcctagcatcacacaggtgcgcaactttataggtccagtctcttctttttgcttccttctctgcttctttttctttttcactaacaccagtttgcataaatgagtgcactgtcgagttcacgtgaataccagacaaaaatacaggtgtcttcataataatcagctcctctaagtctactttccagtttctgcttcagactcagataaatcctatataaagcagacgacacagttatttctagaggaactgaggttactgattagaagggaacgtaatcaggtagattgagccggtgagggaagaaaccattgctgtgagaggggagtgtttgcaaaatgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctggtgagtaaaagctgcagataaatgcaacagccattcagaagaatgataaattccacaagcattcagaagcaggcttccctaaaggtgactcttttggtcaatttgcaacccctgggatatatttggatgactcctgttccatatgcctttctataaaagttaaattggggcttttgttgtgaggaagggaagaaaggggtttgacaccaataacctataggataatgcaaatcactgaaataagaaggaacccatattctactttttgggttgtggctttaatgaactttgtcttcaggtatctaaaattatttctagtatgaagaaaagaaaaaaatatccagaccttaatctataaacgataatatttttacctcaaattaaatttctaaggacgtagactacattcataaactcattagaaaactaatgagggatttttatattaacaatagaaaaacctgtgtttcacatatatatatgggcttatttatgcatatatgtacatatgaatatgtgtatgtgtatatatatacatacacatatacactcacatttttaagaagtttttaatcaaagaagacggaaataacaaggatccttgtgaatagtaatttagacatgtttagacaagcacaacttattaggaagcaaactgggacaattgtaaacagtaattccaggctgcctaattatctgaaatatctcagaatgattttagaggttaaacacttattattaaatggtagcttctaaataaagtgaaaaggtgtagtgatttatcaggtttttttttaattatagaatatcctaaaattctaaattagcatatattctgttgccaatatatactgtcagtatatttgaagtatattaatttctaaattatgttacttttattaaaattccaaagagtttctgacttggacaagttttctctatctttaggaagacagctagtttttttttcaggggggtgagctaaaagagttaggataaagtacaccgcattaaattaaaaacgtgtgttgggaataaagacaatccaaagttaaaagtctatttggatctcaaattttcccataacttgatttgtaagaaaagttacccttttgcaagtcttctctctcatttggtctggactaagtggttgtcatttctcacttacagattgctgttttactaatctctttataaatatattttttaattttatatctgtattttattcatcagattgtcctggaagtacagaggccagttgatggtttatgagttcaagctgagccgaatatagctaagccctgtcttgcctgacatttcatcaaaagctgtgttgatttgcaatgtttaccgacctatttattgaaccttcacagcttgaactatgccaccaagctcgctgacattgctgagattatctctaaatgcatgtacaaactaaggaggaaattgaaaaataagttaaaaacaatcatccgtctatttattaaattatgcttatagagtccttgatttatgtatttgtttgattgttctccgcaaagccccatgacctgatttttctttgatcttcccacacactcttggaagacgatagattagaacagtggttctcactcttccttgagtgggcatcagattcacctggagggctggttaaaccacagcttgctggatgccacccccagagtttctgattcagtccttctgaagtggggccccaacctctgcatttttaacagattttttaggagatgctgatgctgctagattactaagaacagaaaatgagtgttctaatacaaagagcagaaaataattgttcttaatctagttacctgtgttctctttatgcgttgtttagtttacactgtacaagaaaataaacacatatcctcacaaaattgaagcatatattctactaaagattaatatattaaaatattgaataaaatattaaatatctatgttaggaaattgtattcctgctgaaactggcagtaaaattacttaaattacttagcagtaaaattactgttgacaaaagtaaacaattggtcattaggtctcaaatacgtaaaacctcaattttttttttttttcttgagacggagtctcgctctgtcacccaggctagagtgcaatggcacgatctcgggtcactgcaacctccacctcccatgttcaagtgattctcctgcctcagcctcccaaaaccctcaatttttaattactcctttgattcttattctctgcgatttctccctatgtaaagttttagtctattatatttttagtaaaatgaaagcatgatccatgagataagcacttgaatctatactatacatcaaagtctccccttttgggccattaaaactaagatgttttccaacttaccttaccaaagccacagtttgaaaactgaaactatgaaaaaactggatattttgcttaattataatgcttcgtaaaaaattagaacgtctttaaaaatgttaacaactaaagtcaaacattcaaaaattataacctttgctataaagttatatgttcattcattgtagtcactttcttttagtaaaatgtaagcttttgatgtattctaatggggcgcaacgtttagattaaatgtttaatatggataattgacttttaatgaaatttaatctagatgttcgtaactgagagttaggggtgaacatgcctttaaggatgtagacatttttattacaattattttctccatgtttttgattaaacatatcaaggaaatatatattattttttatttaacttttctaatgtattaatttttggccagtcctacctatcacatgcttcagcaataatcagagctttgatgacaatgtcacattattttaattcagatgttattccagtttgataagatggagctgatctttagaaaacaagtgtaccatatttctaatctttaaatattatattgaattatttcagcctggctcacttgccagtttttcccttttgttttcatgattaaagcaactgataattattaacatagataagatttatgacattaatttatggttttcttcataaaaataaagccttttttttttttttttttttttttttagatggactttcgctcttgttgcccaggctggagtgcaatggcgagatttaggctcaccgcaacctccgcctcttgggttcaagcaattctcctgcctcagcctcccgagtagctgggattacaggcatgcaccaccacaccaagctaattttgtatttttaggagagacggagtttctccatgttggtcaggctggtctcgaactcctgacctcaggtgagccacctgcctctgcctcccaaagtgctgggattacaggcgtgagccaccgcacccagccaataaatccattcttaacggaattttagagcataaatctgagaaaagaaactaaggctgtacgtactaggtctcctatacaccttgtctttcatcattgaatccttagtagttaatacctgcttggaatgtaatgggaattcaataaattaattaaataaatggatgagtgaatcctacagacaattttgccaaggaagaaaataaagacagggtatttttatttctttcggttttttttttttttttttttttttttttttttttcagacagagtctccctctattcgcccaggctggagtgcagtggcacgatctcggctcactgcaacctccgcccttcaggttcaagtgattctcctgcgtcagcctcccgaatagctgggactacaggcgcctgccaccacgcccagctaatgtttgtatttttagtagagccgaggtttcaccatgttggccaggcttgtttctaactcctgacctcgtgattcgcatgccttggcctcccaaagtgctggggttacaggcgtgagccaccgtgcctggccagggtatttttatttttattttatttttttgagacagcgtctccctctgtcgcccaggctgaagtgcaatggcactatctgggctcactgcaacctccgcctcctgggttcaagcaattcttctgcctcagcctcccaagtaactgggatataagcattcgccactacgcccagctaatttttttgtatttttattagagacagggtttcaccatgttggccaagctggtctctaactcctgtcctcaagtgatccgcccacctcggcctcccaaagtgttgggattataggagtgactcacaacgcccagccttttatttcaatttttactgctgtttgttttcttccaaatgaataataaatatgacattttattctgatagctattagattatgaattgaatgtgagaacaaaaggcattctggttttcgtttgttttaatattggactgaaaaaaaaaaaaaaaaactcatttgaaccgggcgtggtggctcatacctgtaatcccagcaatttgggaggctgaggtgtacagatcacttgaggtcaggagtttgagaccagcctggccaacatggcgaaaccctgtctctcctaaaaatacaaaaattagccaggttgtggtggcaggttcctgaaatcccagctactcgggaggctgaggcaggagaattgcttgaacccgggaggcggaggttgcattgaaccgagatcgcacccctgcactccagcctgggcgacagaggtagattctgtctcaaaaaaaaacaaaagaaagtagaacaaaaactcatttgagactttcaggatacaataatttgtttaccttttcagttttctgattcctcatggtgaaggaatcatatctcttcagtgacacacaaacacacacaggatatatacagttatgtgttaacaccagggatacattctgatcaatccatactaaggtaatttcatcgttgtgtgaatgtcacagagtgtacttacactaacctacgtggtatagcgtagtgcagacctaggttgtatggtatatcctatttctgtttggctacaaacctgtacagcatgtgactgtactgaatactgtaggcaactgtagcacaatggtaaatatttcaatgtctaaaacatatctaaccattagaaggtacagtaaaaatcccgtgttataatcaaatgggaccactgcggtatatgcagtttatcattgactgaaacatccttatgcagttcctatcttttcttttgggccacacttggaattgaaatggaagctggagaaaggaagaacatgaaataaactgatgtttttccagccagtcaaaactcagcctctgtgttttagagaaagcattcggaacacagttgagagagggagagaaagagaagtggaaggtttagagggaggtccccgcttgtttttatctcttcaagcagctctaaatttgtccaaagcagaaaaagttgtacttcgcttcactctatattcaagactcaaaccaagattaaacatgaacctgtgggaaagttctttttaattaaactcatgttatttgaaaatacattatggtaagatatttttttgaaagttaagagtcagattttgtctgcataatgaaaagtgactaaggagtgctgaagttatcactcaattatcaggaaatctagaaaaattactttccaataaaaatgagcatcaatgatttctaccacagccttttggttaaagagtaatgaggagaaattctgccatgtaattaaagataatgaaattatcaatcaaggctaagctgcattaggttctttgactaaaataattttatacaattttaagtataaattaagttaaaatatatacattgagtgtgtgcattaatgtagacagtgccaaatattcaacaaaattatttcaccacctttgatttttgttttttgttttttgtttgtttgtttgtttgtttttgagacggagtctcactctgtcacccaggctggagctcactggtgcaatctcggctccctgcaacctccacctccaggctcaagcaattctcctgcctgagcctcctcagtaactgggattacaggcatgcaccaccgtgcctgactaatttttatatttttaggagagacggggtttcaccctgttggccaggctggtctcgaactcctgacctcaagtgatctgcccatctcggcctcccaaagtgttgagattacaggcatgaaccaccatggccggctgatttaagcacctttggaatcataattattaatcataaatgaaaccaaactaaaaataaagtataccacatgtgagaacattccaatgaataaaatcatttctgtgtgagctagcctgctgttcaaatttgtttatgcttatgcttcagataatgtttacaaaagtactgacagattcctagaagcacaatttctaaacacttaccttggaggtttctagggccctaaaaatatttctagtcatttcaaaaaaccacaaaacaactacaaaaaatgtacttctcccaaaggccatacgtagcacatgcaaaaagagattctgcagagcattttggaacgtaagtagcttttgtggttctgtgtctcaaattagcctgttcttaaaagtctgcaaattaaaaaagaatgataggccaggcgtggtggctcacgcctgtaatcccaacattttgagaggccaaggtgggcggattacttgaggtcaggatgtcgagacctgcctggccaacatggtgaaaccccgtctctaccaaaaatacaaaaaaattaaccagacatggtggcatgcgcctgtagtcccagctactagggaggctgaggcaggagaatcacttgaacctgggaggcggaggtttcggtgagccaagatagtgccactgcactccagcctgagagacagaggaagactccgtctcaataaaaaaaaaaaaaagaatgataaattgagtcaaaattataaaaattcaacagacgctggcacagatttgagatttgaggaaccagtaaaaaacgtagtacatattgataaatggcaatgtggtgtcaagatattaaaattggttttaatcttattaaccaacataaaatatggaaaacttatacatttaagtgggcccagaaaaaagtttgcaaatagcattccaaaaatcgatagaataatgtgaatgctttgttttctaatcttcacataatagggttggactagatgatttataagatccagtatatagcccctaataataacccctttaaaaagtctttttttttttttttttttttttttttgagagagtcatgctctgtcacccaggctggagtgcagtggcacgatctcagctcactgcaacctccgcctccctgtttcaagcgattctcctgcctcagcctcccgagtagctgggattataggcacacgccaccacacctggctaatttttgtatttttagtagagacggggtttcgccacgttggccaggctggtcttgaactcctgacctcaggtgatccgcctgcctcggcctcccaaagtgctgggattacaggcgtgagccactgtgcctggcctaaaaagtgtttcaatagaggagagaaataaacaagatcctgaagggataagaagatgtaaaagttgttgctgatgttctgccgcatatttctttccccacccgagttccatgcagtatcttgctttgctataaacaggagtaagccagaaatatgaggggttgtgttaatgtcaccagaagcgacctttaactacgaggggatggaagtacttgaaaaaagcacgcagccatctcatcttctggtgcataattctgaggcatgttcctcacagcttctcagagattcaccagcaggactgagccccagaataatgtgctcattgacacacctttgattgcctccttacctttcctaatctcactttctctttcctctcacttgtactttttgtaatcaattgccagataaactgtgtacctgcacctcaaatccttgcctcagtgtctgtctggggagaatctaaagtaacacagaaggttagcgagaaattgtttcacatgcttaaacaaaacagggcaaaggcacttaagatgttagagggagggagggtgaggaaactcacacgggatgacttcactctgtttagtacctaaaagtgaacaggaggtggatcgaaaggaaacagttagtgaacctgcaaatcaataggaagggttagaagactggttatgggagatggaccagatagcccagtaagtgaagaaaaggctcatggaacagcagagaaaatggacatatatcatccatatattttgtttccatcctagtctaatttacccttagatactacaataatcccccaactcatctttgccacttgtgcttttgtccttttctactcactccatactctacatggcctaaaggttgagcttttaaaaacataaaccaggttgtgtcaatctctgattaaaattcgttactgctctgatgcgtccaatatctttaccaagaaccacacttcatttttcttccttttcttctgcagtcttgctgcatttcagccatactgacctgctgccatttctcaaatgccagtctctgtactgctattgcctcttcctggaatgctctcctcatccatcctctaactgccttgatcgccactgaatatacactaacatgcatattgtcagtcacgcagtagtagcttaatatgtatttgcggaataaactaatgggaaagagtaacagcatggttcagttgatggtggataatagtgatttactgagtcacaaacaacatcatctgatgccttagcaaagaggagtaggtattggagaaagaagacaatacttacaattctttacttccttgagctcattttatatgtgtgtgtgtgtatatatatatataaaacatatatatgacatatatgacatatttttgacatatgtcatgttatatgcctccttctctattatatatacaatgtgttcaaggaagtaaagatgttcaataaagttcaaggaagtaaagtctaaggtgtctttgtatgtagcactgaagtgatcagtcagagtccaggcttggctggatatcgaacagtggatgtgtgaagtagaagtgagtgatgccaattttaaagataatgagcagtttagtaggcaaggatttagtgtcagatatggaggttgtggttggcagtagtagtagttgtactgggaagctcttccacagtggtgaagaagcatgctgagaaaggccaaaaagtcaaagtagcatcttgctgtggataaggagattggcataaatggagtaaaagttgagggtgaaaagtgatgtgagacaaggacaaatagacaagttggcttggctaatgtaatacccatgatgtaagaaaagctatgctgagatagctaggctaattccaagggacttttgaggggagcatatcaggttatcacatgccaaaaatgtttcatttcagagactttagtcttctcattaattttatcgctaatccattcattttcaaaatgtatttcaggatttcacatcaggtcgactttaaatcttttgttcagatgaacgtttcttttcctaggactgagtaagacagtttgtcctatccagtgcttaagagtaaagcaagcttatgttgccactgcaggcaggattattaaataaccaattactattcagactgtgtcacatccctttaaattactcaagcaagagtcttggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagagtcttgaacttgttcagcctgaacacatctgatatcctcagccaagtataggatgtaaattagatagcttctggctttactagtgtggaatcaggcatgctttttccccttaggactccatgactaatgacctgaattgtctacatttcaagactagtcagatctctaatggtgaacctatttcattgtttctgcttctgttttgtcccgtagtatatgagacaaaggatatttttatgtgcaaattgcaacaagttgagatactcctttaaaaatggattttctttccatagttgattagcgtatggtaccagatttcctagaaatgtttttatgataaaagtttcaggttctcgatgatgcaaggaaattacagacgttaggtaatgatttgtaatcaggacacatgagaggagttgtaactttactgcttaccctgtggctttgagaatcattaatcctcaatgggcctcagttttcatatctaaaaatactgctttttaggttcagttacttcaagggtcaaatgagataaaatatatgtgttataacaataaaatgtaataataaatatgaggtaccttttcccccagctttattgaggtataattgacaaatggcgattgggtatattcaaggtgtacaatatgatgatttgatacatatacattctgaaatgattatcacaatcaagttaattaatatatccttcacctcacatagttgccattataattttttatgatgagaacacttaagatctctcttagcaaatttcaagtaacaatagagtactattaactatagtcaacatgctgtacattagatccccagagcttactcatcttataactgagagtttctatccttcgaccagcatttccccatttttttccatccccagttactggctaccactgttccactttgctttgatgagcttaacttctttagataaaatgagttactttttgaaaaacaagtttaattggcaaaattgtatatatgtattgtgtacattatgttaaaaaatatatatatatataatgtggcctggtgaaattgagctataatagtagtgtttttaatgactatgtagccgaaagttccaaggctttcagctgattgactatgtaattcttaaatctagtagagtatcttctgatttgagagcagtatgaatcctggcagaaaactatgctggctatacacttttaagggtttgaactgtgttactttatctatatactctgcataaaatattctctctcctatacaggccagctcatttattcttgcttttctagtctgattccccctttctggaatctttttcctccatcgacttttggttctaaagcattcccatcttcaaaaattcaattcaagtcctagttaccacaacactttctctaacggcttgaaacacctcttttttctatgaacttttgttccacatagttatttctacccagttatcgacataattgcttgctaattatttcctgtggattaactttgattccataactttttaacttttttatagatttcctgagagcacgtgctgtgctttatatttctttgtaaatacctcagtagctctgcattttttttctctgtcatccaggatggagtgcagtggtcgatcatggctgactgaacccttgacctcctgagttcaagtgatcctcccacctcagcctcccgagtagctgggactaccagcgctccaccacacccagctaattttcgtactttttgtagagatggggttttgccttatcactcaggctgatctcaaactcccgagctcaggtgacccacctgcctcagcttcccaaagtgctgggattacaggtgtgagccactgtgcccggccagccctgtggttttttgtcgttgttttggtttttttgagactgggtttcactctgtctcgcaggctgcagtgcagtggcaccatctcggctcactgcaacctctgcctcctgggttcaagcgatttttctgcctcagcctcccgaatagcagggattactggtgcacgccaccatgcctggccaatttttgtatttttagtagagatgggtttcaccatgtgggccaggctggtctcgaactgctgacctcaggtgatcctctgtcctcggcctcccaaagtgctgggattacaggcatgagccgccgtgctcacccagctctgcatttttgaatcattgtttataaaacattgagcatcaaataatatgtttttaaatattgtataagtaatactgtgttcatagaaacgttttcttttggccgggcgcagtggctcacgcctgtaatcccagcactttgggaggccggcggatcacgaggtcaggagatcgagaccatcctggctaacacagtgatacaaaccccgtatctactaaaaatacaaaaaattagccgggcgtggttgcgggcgcctgtagtcccagctactcaggaggctgaggcaggagaatggcgtgaacccaggaggcggagcttgcagtgagccgagaccacgccactgagctccagcctgggccacagagcgagactccatctcgaaaaaaaaaaaaagaaatgttgtcttttacaaccatatatttatcatatttatcagtagtttaggcgtggtcttgaaaaggaacctccccctaccataatgcctttcgtttaggagatccccccattacacttgtggcttacattgaaagaaaaaaaaaattatccccttgtctatggtagaaaactgtgtcattcgtggctttgactgcatcacaatccattttagctttttgtcacttaacttgagaagaaatgaaatatatgtggagtgtatatccctgaagaaagtaaaggaccagctgttatcactatagagtttgtattgttgctgaaaataatctggttatgtttgtaaggattaagtagtttattcaacagatgtttggtagtaaacatgaatgagaaaaggcttgttcttatcatattcattatgaatgctgaggttgtgctttactacatgttttcaatgctcatcctaactgaaagtatgaagtggaaggatcaatttctgaatatttaaatgagatgttgattgccttgttataaacattaacaattttcctaagtgtttgctcttgagatagagcatctttaggagaactttatgatttgggctggcagatttagccaaattaacaggaatgtaccttcctaatgtgatcattcatccctaggaacaggaatctgggaacactgaggctatacttctgtatggtgagttatcaaagtgttaaacacaggcactattaatgaagcacagattctactttcagagtaaagctagtgttactatctatgaaaaaatattattatttatgttttcataataataacttctacattatatttattttcaactttttagaataaatctgagctaggaggttcttattttagttgttttccttctatcgtttttcattacgctcttgttgtttgatttggtctcacattttaaaaagcttactgtataagaaagttttatcttcaaaataatgagcactagaggttactataaatggaaatacaaaatgtggatttactaaagtgttttgacttttacctacacatttcttggagtaatttttaagttgaattttaagaattattttgctggccgggcacggtggtggctcacacctgtaatatcagcactttgggagtctgaggcaggcggatcacctgaggtcaggagttcgagaccagcctggccaacatggtgaaaccccgtctctactaaaaatacaaaatttagccaggcgtggtggtgggcatctgtaatctcagctactcgggaggctgagacaggagaatcgcttgaacccgggaggtggaggctgcagtaagccaagaacatgccactgcactccagcctgggcaaaaaagtgagattctgtctcaaaaaaaaaaaaaaataataataatattgccatatattcgaattacacaataataccagattgaggatattagaggaaaacaaatattatattttcaatatttctaaagtattttttgtcttggttatttttatggaattatattacatttatagtataacctaactcttaaccattttgaggggtaagtttaaagattaacttatcactattgacgaattattcatctacccgtggaagtgtctgcagtttatccatttcgaaacatctaatattacatgagaatttacttttctcattagattacataaacatcatgttaaaatgcaatatgtacatgtgacaactgatcttttgggaaaaaaaaagtccatgaatcactcctgtaacatttggaattaaattcattaaccaaaataatatcatgcttcatcttttatattttgcttccttagcatctggttcttagtctgtctaattacattataatggctctgtgttacaacagttgctagaagatttttttgggggggggggcaagaatgatgattttgcctcatattttggaatacctgctttgcaaatgtctttcctatatactagagccagaaggaaacaaatctaatgtttcttattcgtttgaaatttattgggagaccaacttcattcaaagatcaagaactctaaaatttttacatcaaaaactatttttttccccaattactttgttgagtactgcacttccagtcttgagatcgaaagtaatgttgaggccgggcacggtggctcatgcctgtaatcccagcactttgggcggctgaggcgtgcggatcacctgaggtcaggagtttgagaccagcctggccaacatggtgaaaccccgtctctactaaaaatacaaagaaaattagccaggcatggtggcgggcgcctgttattccagctactagggaggctgaggcaggagaatctcttgaacttgggaggcagaggtcgcagtgagccgagattgagccgctgcactccagcctgggcgacaagagcaaaattccatctcaaaaaaaaaaaaaaaagtaatgtttagccttgaaattgctaatacaatggacggtatccagcatatttcttttttgtatgcaattaatatttttactttatttattttatttatttttttgagatggagtctcactgttgcccaaactggagtgcaatggcgcagtcttggctcactgcaacctctgcctcccaggttcaagtgattctcctgtgtcagcctcccaaagtgctgggattacaggcacgagccaccgcgcctggccgatattcttactttaacagttgaataagttaatattttattggagctatgcaattagttaatttcatatagtgaatatattaatatcttatgaggaagagccacaattttagtataataatgtagataattataactcaggaggactatgatcaagatacactgtaaggatccttcaccatattttaccaaaatattattttatagttcaaagggggataggacggtacacttccaattatgctgcaaatttgttattattactgaaaaagtctattttcttcttcaagcaattaactattaatgtctttaatgtcaataaaccgcatagcgttatagactctctttgaatttctctgaattagaaataatttttgaataggaagattaacacagactcattttaattctgtaatggtagaaataattaatctccccttatctgtagggatacgtgttctaagacccctggtggatgcctgaaactgtggataataccaaaccttatgtatatattatgtttcttatatacatacacatataacaaagtttaatatatacattaggaaccataagagattaacaacaataactaatattagaacaattataacaatatactgtgataaaagttatgtgaatgtggtctctatctctcaaaatatcttattgtactgtactcatctatttttggactgcagttgatcatgggtaaccaaaaccatggataagaggcagactactgtgtattttattatatgcatgttatatataatatatgtaatatatattatttgtatccatttggcaaacaattgagatttttatttcatgtagttgctttttgtactaatatagttatatggttgttggaattatgtcattaaaacacattaagccaagcatgctggctcacgcctgtaatcccagcactttgggaggccgaggcaggtgaatcacttgaggtcaggagtttgagaccagcctggccaacatggtgaaaccccggtctctactaaaaatagaaaaaaaatcagccgggcgtggtggcaggcacctgtaatcccagttacttgggaggctgagtcaggagaatcccttgaaccccagaggcagaggttgcagtgagccaacactatgccatcgcactcgaatcgagcctgggcaacaagaatgaaacttcgtctcaaaaaagaaaaacacacacgcacattaagagaaattatgtttgtcgttttgtttattctctaatttgattaaattgaacagaataataagtcacgtatggcaataccaaatattatgctaaaaataaaacactgaaagctgaaaaattcaatcacagattattggtttatatgacatcaggcttcaggctgataggagacgtccaaatgataggcttattttgttccataagtattgggcacggttcttagtataacaaagaaataaccgtggattgagaaattgttttcctcaccttcattacttaatagtagaattcccttcaatgtgccacttaatattccttgatgtcagagccttccatttgagcagctgaaattattgacacccctctcattcttcaaggatgtgttgtagggactgctgagtttctgtagaggtttaagctttgtgggaaatgatgttgagtatgacaatgttatcagcaacattgtcaacttcatggttgcctattgacttagggaaaagtggagaaaaatatgacaattgctgagtgcttagttgcagtagctttttaattttaattttcaagcatctgtgtataagcaaaagaatatacacagtgccacgtatcatacccattgacaagtttatcagattttaattataataaatattttaattaaaatgttttttaaaattattaattttaatgaacatcaaatttctctcttgtgatgtgataagggcagtgatagaactgacatttgaacgttcaatacacaattcggccaccattcaataggcttggattgtgcccatggttctgttctgtactaaagacacaaagatgaacaaataaaaactctgcccttgaagccatacagtcaaaatacagtgtccttaatctggggtccatgaaccatgataggaaaaaaattacatctttattttcactaacctgtaactgaaaatttgcatttctttccctttatgaagataagcaacacagaacggtattagcaatatctgtgaatttattaccaatatttttatatcaaatcctagttgttttggatatcttgaaaaatcatatgttaatatataccagtggttagtatactaatcactacttttaatttgtattaattattatgcttataactaatgtattaatagcatataatagtattatattcagtattttacaattgcaatataattaatttcctttgttttttatatgcttttagttttcattttgcacatttgaaaacagtctgggaagtgttccatatgcttcaccagatgccaaagggatccatagcacaaaaatagttaaggaccccatatctagaagagacacaggcaagtacatataataccatggtacagaaaaataacagaggcttgtaccatatgctgtgaaattgggcataactctctcagtccaaaggactgaagaggaaatttttgatttggccttgaagcacacgtgattgtttctctagtggtaacatgtgagagagggcattctaaaaaagagaaaagtaggtgcaaagtcgaagtcacccggtgagagcttgcagggtcagggaacaaagagcagtgtactgtggcaatgtaaacaaacaaagaaacaaacaaaaaaaccttttttttttttaaaccattgttgggcatcctattctgttttcatttgtcaatgtgcaagattgcatttgccaagcagtttttattaatcattagtgagtagaaactattctctggctttttattttaactgactatatttcatatagacaacaggcaagaaacatcaaagaagagatcaaagctctgcattagcgttttaaatctcattatttcaaacaacatctacctgtaaggggaaaaaaaaccgtaaatctttttcacctccccacttcgtcgttgttttcagacaacgatcagtcacttgtctggcctgtgggccataattggctacctgtaaatctcaagagactgaaccatgtaactggaataattttttttttttagcactacactacacggctgttattcagttataatggtcaaggaagctttagatgctgtacttaggctttctaaatgtgtgctttatttggctttctgggagaaatgtcaatgtgaatttccagattataatgaagttcatccagaaaaacaactatgatttaaagaagcagaagaaacaaaccggactgaaaaaatacactaatagactaagatagtgttttcaaactgttctagattaagacaattttgcttgcattctttgttgagcaagaaggttcacatcttaacttttccaataatcctctttaagaccgttattattggccttgatttcaaacagaaaccagcagggacctgaatggacactactagttaaccagtctaaagccttatgttaaagctaaacagttatctctaattttcaaaacaatagcatgagtatatattaaaaagtggttgatctagggaacttaatattccaggatgaactatactaaatgaaaatatgtaacacattaaaatgtggtcaaacaagccatctatagctgatagtacaaattgcatatatatctactttattaaaattttaactggccaataaaattgatactataattctaaatataatttttatttaagattacaagttttaaaattgaacagacttaggtttaaatcacttctctctcttcttctttttttttttttttccgaaacggagtttcactcttgttgcccaggctggagtgcaacggcgcgatctcggctcactgcaacctccacctcccaggttcaagcaattctcctgcctcagcctcatgagtagttggccctccaccatgcctggataattttttgtatttgtagtagagacgaggtttcaccatgttggccaggctggtctcaaactcctgacctcaggtaatccgccctcctgggcctcacaaagggctgggattacaggggtgagccaccgcggccagccaaaatcacttcttaaatgtgttattctgggcccagcacggtggatcatgcctgtaatcccagcactttggcaggctgaggcggtccgatcacctgagatcaggagtttgagccagcctggccaacatagtgaaaccccgtctgtactaaaaatacaaaaattagccggcctggtggcacatgcctttaatcccagctactcgggggtgctgaggcaaaagaatcccttgaaaccgagaggcagaggttacagtgagccaagatcatgccactgcactacagcctaggtgacaggtgacagagggatacttcgtctcaaaaaacagaagacaaacaacagcaacagaaaatgtattattttgtattagcttagctcagcatgtttgcttgtatgtaaagtagaactgaaaaaaaaacctaataaaattaaaatagggattaaatgcactaaaatttgttatttgttctacgtatttcaaaaatggtagtcattctaattatttattttagttaatggaaacattagttttattgttagtaaaacaatatattgttgatacaatatctagcataattttgcctcttaatgaatcaatcagcttgtcctttttattcatattttccttaattataaaccaattttttaaaagtcataatctatcagtagaaatggtactttattaaattcggagaatagtatcatttaaggaaaaatattcctagataaaaaaatatacagtactatgaaattcacatgcatttaaagtcattattaatttataaagaatctggaattataacctgaactaaataattctatttttttgctgaatgaatgaataaataaatgaatctttaggaacttgactgtcctccactaaagttaatgactccttcaacatattacacattctgttgctttgttctcatttctattataaatgcaagtttgcttttttgcatatggaatcaccatctataaattcatagtcaatatggggttttaaataatcattaccatggaaattatacttaagtattagttctgttggttggagattatgaatttctaaatttaaaaaaatgctgatttaaatttattatttccagtgccctatcctatttttttttcatatctgctactgccttcctaataaacttgtttagaaatatatcttgacagcaaatggtattttattcctaccctcttggcatgtattatacacaaactttgttttttgttgttgttgctgttttttttgtgtgtgttgggggggggggggggacagagcttcgctcttgttgccgaggctggagtgcaatgatgccatctcggctcactgcaacctccgcctcctgagttaaagagattcttctgcctcagcctcccgagtagctgggattacaggcatccgccaccacagccagctaatttttgtatttttagtagagacggggtttcaccatgttggccaggctggtcttgaactcctgacctcaggtgatccgcccacctctgcctccgaaagtgctgggattacaggcgttgagtcactgcacccggccttaaacttcttttcgaaagctttctcttttatacgtattgagttaattcctgtttgcgctgtgacatctacctgactaccacaaaaccttacagccacttgcttctgtaaatggaaaactgccctagcatgacaggatgtgggctgaagacataaccatatcgaaaacagcaagctttttggaaatctgtgtttggccctcaatttcatggcctcaagtaacttgataattttctatttctaatgcctgtcagccacaacaggatctgataaccaactaaaatctctgttggaagtgaataggggaaaataggtgaaatcacatttgatgttgtaagggaagcttattgaagacagtggatgtgttcaaaacattatgaggcaaataatgaggaggaaaaaatatgaggaaatagatcaccaggaagccctgtgaatgtttatgttttggctttacatgattactagtaattaaattagtgaaaaatattttatggaatattcaatatgcccttaatgtacaatttgctgagcaataagaatataagactacaaacttcctcttattggaatatacattttattttttattttgttgtacttcaatagctttagggtttcaagtggtttttgcttacgtgtatgaattgtataatggtgaagtccgggattttattgagccgtcacccgagtagtgtacgttgtacccaatatgtagttttttatccctcattcccaccccctccacttctgagtctctgaagtcccttatatcactctgtatgcctttgcatactcataagttagttcccattataagtgagaacacacagtatttgattttccatttctgagttacttcacttagaataataacctccagttccatccaagttgctgcagaagacgttatttcattgtttatatggctgagtagtattctatggtgtgtgtgtgtgtgtgtgtgtgtgtgtggtgtgtgtatctcacattttctttatccactctaaggtggattctatatctttgcgattgtgaattgtgctgcaataaacatatgtatgcaggtgcctttttcatatagtgacttatttttattttggtagatatgcagtattaggattcgtggattgaatggtatacctacttctagttctttgagaaatctccatactgttttccagagaggtattaatttacacttccaccagcagtatataagtgttctctttttatcttgtccatgccaacgtttattgttttttgactttttaataatggccattctggctaagataaggaagtatctcattgtggttttaatttgcattcccctgatgattagtgatgttaagtattttttcatgtatttgttgatcatttgtatatcttcttttgagaaatgtatattcttgtcgtttccaagctttttaaagagattgttttcttcttgctgatttgcttgagttctttgtaggttgtagatattggtcagttgtcagatgcagtttgcaaatatttttttccattctgtcggttttctgtttacgttgatggttatttcttttgctgtgcagaagctttttagtttacttagatcccatttgtttatttttatttttgttgcatttgcttttgaggtcttggtcataaattctttacctaggccaatgtccaggagagtttttcctaggttttctttgaggagttttatggtttcaggtcttagacttaagtctttaatcctccttgagctaatttttgtatatggtaggagatagggatccagtttcattcttccacatgtggttgtcccattttcccagcaccatttattgaataggctgtcctttgcccaatttatgtttttgtatgctttgttgaaggtaaattggttttaagtatttggcttcacttctggcttctctattctattccaatggtctatgtaggaatagacgttttaaaatgttgcaattggaactatggataaacctttaagataataatttttagccactgttcattttaactgggggagaatgggaaaaaagtttaatcactttaactaaatcagttactttgtttacatatatttagctctgataattacaaggagattcacttttgagtttgaaaagtagattctaatgcctaatgagagttttcacattgtctttgagaataaacactattttaggttattactgatatttcagtttgtgaactaataattcagcttgtgaattttacccaattttataaattcacttttcttacttgggcgtctgtgtttgaattaagaatggttaaatgtttctttcatacgcgtccgtgtgaagagaccaccaaacaggctttgtgtgagccataaagctgtttatttcacctgggtgcaggtgggctgagtccgaaaagagagtcagcgaagggagataggggtggggccgttttataggatttgggtagataaaggaaaaaggggggttgttctctggcaggcaggagtgggggtcacaaggtactcagtgggggagcttttgagccaggatgagccaggagaaggaatttcacaagacaatgtcatcagttaaggcaggaacaggccattttcacttcttttgtggtggaatgtcatcagttaaggcaggaaccggcaatctggatgtgtacgtgcagatcacaggggatatgatggcttagcttgggctcagaggcctgacagtttctacatgatagtctctttattcaaaagaaacacactacattattattttaaaacgttattaacatatttttctgtgctagaaaattttaagaaacaaacatttaagtgggctaactcatttagaatttgtaaaatatgacaaaactctaggagaaagtttacctgtgaaaggagtctgttatgtaaatcaatagtgtaattatgattcaataaattatataaattcctaatgagcactatcaatttttcttttgctaaaatctactgatattctacttttaaattactctcacttttagtgttcccctgaggacttatcagtttggaacacttaaatttgagttatcgttctgttcttaggaaaaatatatttaaagaaataatgatttattatgctagatttatcattatttttatttgggattgcttttaatgtgcatgagttacaaagacataactgtgagatcccattttctataatttttttagtgattccatacatttctgagtttacattttttaaaaattatagctcaaaaaatgcaagacataagtaagtatgcttttctaatgggtcatttcagtcgcgtccgtgtgaagagaccaccaaacaggctttgtgtgagcaataaagctttttaatcacctgggtgcaggcgggctgagtccgaaaagagagtcagggaagggagataggggtggggccgttttataagctttcggtaggtaaaggaaaattacaaagaggggttgttctctggtgggcaggagtgggggtcacaaggtgctcagtgggggagctttttgagccaggatgagccaggagaaggaatttcacaaggtaatgtcatcagttaaggcaggaacaggccatttccacttcttttgtggtggaatgtcatcagttaaggcaggaacaggccattttcacttcttttgtgattcttcagttacttcaggccatctgggcgtatacatgcaggtcacaggggatatgatggcttagcttgggctcagaggcctgacaggtcagttatggaaacacatcaaagtactctagaaccaaaagttaatttttgaaagaaattaacttaatgtacagattttataggaattctggacgtatttaatatcgtgatgctagaagaatgtcttaccaattaatattactggatttcttgttgtgtatcaagttgtaacagataccttaatcacctaccagataggctcattcctgtgtccattccaatagaactctgattttgctcagatctccatcctcacaatttcacagtagtcttcagtaaagaaatgagactaccccttgtcacagaaaatgaatcatactttaattcgcttatatgcttccataccacttgccatttacgggtttaagtatgtgcatgagatgcaacctgaaccaattaaacatcaagtaagtttttcttgccaatgaaaagcgttcacttaacaactaaatgcttgagcatttatatgtagatatatatgtacatatatacgatgtaaaatgtagaatgcccactgattcatttataatttgatatgtattagtatgtatttaataagctcttataagactgaatggactctggatatgaaataatataccaagtatggtaacacatggtaacacatggacaaattgtagtggaatcaataaagcattcagagaaatacatcattattatttattctcccactttaggaagatttcaatcctagcattaaatgtaacactgtcttttttaaaataaaacctccatttctaagaagttatttgatgagaaaatatttgagaggttatctgatgagaaaatttgaagaaaaaaattttaactgtacaaccagttaattagaactttgtcaaataacattgcctttaattcccagaaatccaatacattatgctcagtgaactgtaacacctgagtttttaaagtggaatacttaaaaaaaaaaaaaaacaaaaaaaaccagccttctggggtaatatctcctctttggaagtttctttttttccaaaattatacttaaaggacgattcttttaatgaataaattttagagttatctcaaggaataaatagaggaaatattattttatttcaaagagaagaatgtctattgtggcaaacaacaaacctgaaataaataaaacgtgacagtctatgaagtccgtgagcctaaagaacaatggttattttactgtcttagaaaagtttaggaagtttggatttgaattcaaactttaatttgaacttataacgtcaacttgaaatcatttggaataaacattgaaaaccttctttgaaagttttatcaaaggagaaagaatttgaataccaagaggatggaaaggttaacttctgttatctgaaatatcttcaattgccttgagccagtttaaaaataaacaagcttactgatatagagggaaacaagtctaccttgtgaatataatttaaaaaagagaaaaaatgtcatttaccatattatttacttcctcattttagaaaagggaataaacatttattaattatgcactatcaggcactacgcattcaacacacactatcacattagttcttcccaaaagccatttgaagtagtttttctttctttttttttcttcttttcttttctttttttgagagatggagtcttgctctgttgcccaggctggagtgcagtggcacgatctctgcccgctgcaacctccgcctccctggttcaagcgattctcctgccttagcttcccaagtagctgggactacaggcatgtgccaccacgcccagctaatttctgtattttttagtagagacggggtttcactatacgttggccaggctggtctcgaactcctgacctcaggtgatccgcgtgcctcggcctcccaaagtgctgagattatgggcgtgagccaccgcacctggcctgaagtagtttctcttatgcccattcatcaatatagataatagggttcagagagatttttcagtaatttacacaagattttacagctcctaggtggcagaatctagacttaaatttagatctgatccaaaaactgtattttcctagctttagtaggacattaacaatacaagtgcctctttaatatgcttaggaatgcatttttatttatatgtaaaaccaaataaacaaataaacgctgcgattgccaacaaagtatctttaatgtaagaatttcaaatgctgtgcaaaattatcctcactaactgctcttctggtcccacacttgtcacatggctacagaatatactatatctctctttctcttccagcagcttcctagtggccacacagggaccatcctatccataggttatagttgctttttaaaatctaggcatttcctaggagctgatgagattttagaagaggtgatattaacatgaaaaaattggtaggggtagatttctgagatattctatccaaattcaggagttttacaattataatttagttaaatattgtacttgatacacatataattccattaatacactctgagttaattgattttcatttattactcatggttttcattttttgttttttgttttttgagacggagttttgctcttgtcacccaggctagagggcaactgtgcaatcttggctcactgcaatctccgcctcctgggttcaagcgattctcctgcctcagcttcccgagtatctgggatgacaggcatgcgccaccatccctgactaattttatattagtagtacagatggggtttcgccattttggtcaggctggtctcgaactcctggcctcaggtgatccacctgcctctgcctcccaaagtgctgggattacaagcgtgagccaccgtgcccggcttcatcgtttccatctttaacaaagaaatacatgatatttaaagaaattttaaaagtataattttaaaacagagggaaagccacccacagctaaaacatcctttctctaaacagtttattttttccttaataaagttagatattttttggtgtctaactttgcattgtaaaacttaatcattacttacattgctccataatattctgtcatatggttttgctgtagaactgatactgagttggtgtgccccttgtaagaatagtccagtcattttaaaccagcatctgtttggattgggccagcatctcttccagtgtccttgagtcaacaatgccttaatggtttctacatatatttttaaatattacctatagatagttcattctttatcttcttatgttgcgtgtcagagctattacgttagagctattatgtaattttggcttttttatatatcattgcaattaacactcttgtccattaatctgtttgggttttttttgttctctagttgacatcttatgacaaatcaataggtgtgtaaactatgtcgatttttcttggctgtaaaaaacagtaaagaatgcttacagtacacgttgtctttatgaaaggaagttccatttgaagaaataattaaaaaacaatctgttttgcctttaatgggcaagatgaagagttaatgccactatatactaaatatcttaatctcgacatgaaatgagaactattctagagatatgtttctagatagatatggaacaaccacaagttcatacaaaatttgttaattttaagtcatattttggacttttattaactcatatggagtgacgaacaaatccttaattaatagcagacatatcatcatctctggatgcttatctatcagagatcagcaagaaaacaaacacacggcatgctaaaatgggtaaactatgagaggcaataagaaacaatattcaaagttgtgggtagggttaagggaaactaatgaatactgtgatgcaggtggcccctggctctggggacaatagaaagacataacccaccactaggcctaaaaaaggtaaaatgtgagggagcaattactagatcctggaaatggaggagctgaggagagaccgcccaacaagagctgtgacctttgaaaaagaaatacagccacttacaacctgagctcttgcaggtgtaaaaagtagaggtttctctccaaagaaactttcctacccatctaaatgggaataaatagtaacgtctcctagaagcaaaatttattaaacgacctgtgctaacattcttaaatatctactagccgtaataaagaaatcaatgtactttatgttcttagttcccacaatttagcctaaatatttgccctggcatgcttatactggtccaagcacgcattaggtcatagcctgttcctcttccttatttgaaggtgtttttacctttctcagcaagtaacttgtggaaacaagttacttcctccttcctttgttctcctctgcctttgtctcttttgaaaagttctaagttgctagccaatcgggacaaatacagaatgtgtggtcctgttccagccaatggaaaccggacacagcagtagagtaaacatgtcaggttataaatgaccctgtctcctttgttcggtgtactctcgtggcaaaactgctggcgagtgtaccctttctgcaaaaagtaaaaatgaccttgctgagagagttaaatttatgttcgagtgctgtttctttgcagcaccagggaacaagcattctgtttctaaataaacattgtttacatataacacagggaaggagcagtaaagaggatacagcctccacacacctttgaaaagcactcaagttataagtctttagtgccgtgctacttaagagaagggcttgggtttgccctaggttatggttatgctaagctcctcacaatttttataccacatccaatgacagcagacccattcaagcagaattggtttacaccatgagaaactataattcaaagaaagttagcaacttgctcctaggcatacccatattaaccaatattattcagtatatttatatacagcgcagagaacaacaattttaatggcattgtcagtattctttgatagataagcaccagttttgtgatatttaaaaagctattataggtgttgaggcttcgttttctcttccgctaaactgggatgaatctttctgaacagaacaaatacatatattctgtcctatctgggaaagattcaattatgtgttgcagtccaaatatgctgtattatatttacaggtaaaatcatactagcagaccagagtaaataactaggtaagttcctcttagtgacaataaaaagttatattgctcagatagtgctaatagaactttctgcaatagaaatgttctgtatctatcatgaccaatatagtagccaatagccatatgtgactattgagcccttaaaatgttactggtggggctgggcatggtggctcacacctgtaatcccagcactttgggaggctgaggggatgaattacctgaggtcaggagtttgagaccagcctggccagcatgatgaaaccccgtctctactaaaaatacaaaaattagccgggcgtggtggccagtgcctgtaatctcagctgcttgggaggctgaggcaggagaattgcttgagcctgggaggcagaggttgcagtgagcccagatcacaccactgccctccaggctgggcgacagagtgagtgagactctgtctcaaaaaaaaaaaaaaaaaaaaaagagtctcatgtataaatactgttttggacacacatcgttagaagacagtaaaggtgacactgtaaaaattttaaatcattaataactaattaccaccccaatgtaaatttcactgatcactgtcagtattaattctacagtaacatctgtatcaacaaatttccatatccctttcactggtattagggaggagatatcaaaagatggtaaacccagagcataaacttgtagatgtttggtaatgaaatgggactggacctatttgagattgtttcacaattttaaatcagggattggttatatagagctttctttcttgtattttttttctgcttctatgtggaaccatctagaatgcttgtgttattgctttaaggaaagtttttaaagggattcttaaaaaatacagtattttcctagcatatctctgaggtgataaaagtctaagaatcatagtttatgtgttttattcagatccagctcattctctcaactgttaaataagattcttgagaacaggtattattttttacattctggaggatccttatagcacatagaactatactgagaccaaactcgataatttcttataattttgattctgctggtaaaacacaaacttgatattgaaaatttgaatattctggacattataatttgcttatgaatcattctgtttgatattcccagataccctttgctaaggcagctcagaagggaaatatttgttcttgcagtttgtgtggttacgtggtttgttgtaaactttccctttgacctaaagaaatattgtccctttggccaggtgcggtggctcgcgcctataatcccagcactttgggaggctgaggcgagtaaatcgcttgaggccaggagttcgagaccagcctggcccacatggtgaaaccccatctctactaaaaatacaaacgattagccaggtgtggtggtgcatgcttgtaatcccagctacttgggaggctgaggcaggagaatctttgaatctgggaggcagaggttgcagtgagccaagatggtgccattgcactccagcctgggtgacaagagcaaaactctgtctcaaaaaaataaaaaaaaaaaaagtcgtctccaaaatatagcatggcttcaaacagatcgcattatctctctgaaacattttaacttatagatttaaaaatatatcttacagaaacattatttagaaacacaactttagtttacctacctctataaaatctccagagccagagtaaagattaaaatatgcattcacaaagagctttttaaatcatctctttattttacatctcccaaaaattctggaagaaggccgggcgcggtggctcacgccagtaatcccagcactttgggaggccaaggtgggtggatcacgaggtcaggagatcgagaccatcctggctaacatggtgaaaccccgtctctactaaaaatacaaaaagttagccgggcgtggtggcaggcgcctgtagacccagctactctggaggctgaggcaggagaatggcgtgagcccaagaggcggaggttgcagtgagccgagatcgcaccactgcactccagcctgggtgacagagcgagactccatctcaaaaaaaaaaaaaaaaaaaaaaaaaaaattctggaagaagtagtgtttgatttagcactcttaagggacaccatacatttgatgttgttaaaatagcttacaggtttatattagatttctattatctatcctgtcttcatttttggatatcatgtaaatatgttagataaataaattgagattgatttctaacaatttgtatgcattttgagatggcttagaaaacattcaatgcagaagttgatactgtgactcataccaagcatgctcctttgaatataagaagacaaaacttctgaaatgaggcaaatttaaaatatgacaggtttatattctggaggtagtgctaatagcccccaaagctactgatacatgagtttgtacactacagaaaagagaattaaaaagaaagtttgcacttcattgcagttccactcttgattattaatataaatcgaatgtaaattagtgaacttcctgtaaacacaacatgagcaatgactaatattgatagtctactcttaggttcccttgaaattgttctgcttgtctgataaaaccataacaagggacataaaaagattgttttaatatgttgagtgaattgtacatgaaaaattacattcccataaaaggctgatctatgaatgctaacatttatgttgttcgctatttctgtgtacttataccacccgtgtgagtgttgcttgatttggcagaagtaatggaattttaaaaagcagttgcatgagcaaatatatctattttccatatgtacatatttgcaatttagcaagtcatttgcttttgtttaaatattcaaaacgttgtcatatgtgtgttgtacacattaagattttatgtattttaaaaattatatatgtgtattgatatatttgtatgcacacagagcaaagcttgaaatagcaaaaggtaattacatgcatattgtatatactactttgtattaaaaatgtagtttattgatctttaaaaccaaatttgtttttgtaataaagagtaataaaaaattagattatgattttttcctttcaaatatgtttagaatttaaaaatcttggctacccctttaacctaaaatctgtcttacttacctcaaaatgcccttgatcccaactacatgaaatttcttgctctttcttttttttctttttttttttttttgagatggagtcttgctctgtcgccctgcctggagtgcaatggcacaatctcagctcactgcaacttccacctcccaggttcaagcgattctccctcctcagcctcccgagtagctgggattactggtgactgccacgatgcccagctaattttttgtatttttaggagagatggggtttcatcatgttggccaggctggtcttgaactcctgacctcaggtgatccacctgccatggactcccaaagtgctgggattacaggcgtgagccaccgcgcccggccttcttgctctttcttaaatatattatgtaattttatatagcacatgcatatttctgtgtctgggacacccttcctccctgtatctactccttgctatttcttctagcctaatttagatccctctttctatgtttctctggctcttttttcttaagatttgtcaagtcatgctgaaactattgccttgtctttctcaaaagactgtaagttcattgatggcagaacttaagtgtatattagtatctcccagaactcactcagggcctggcatagagtagcataaaagtcagtgttgttgaatgaatgaagaaatgaatagaatgataactgctttctacaggtgattgtgtgtaaacaaaaagtcatatgattaatccttctatgagcaaaagttggctaagattacaattaaatctgaatgtgaagattgtactgcagaaaaaaaaaacacacattttcaatagttatgtcacaaaagcaacccatcatgatacaagtagaatctgcgaacatttcttttaaggtgcgtataaactcatggcaaatttatgttgcattagtctttttgatgttctgaactttcataaaaaatcaacatagtatttaaaatctattgtaaaatatattgaagtttcattgattttattaaaatattaattcctttattttatatctatatataatataatcaaatctgaaaactcatcaagattatggcctagttgattacgtcttagttattatttgtacttttccatagccaacatgcaataaaagtttggttctagataattttttcctgttttacaccgtttcaatcaaaacatgttacaattgagtaaaacaatctgaaccagccttttataatacatgaattccaagattgtactaatttgtcagtttttgcttactgtctttcacaatgatttggagacataataaaatgtgcaaccaaattagtgaaaataaagaagtatatatataattgactagagccaaatatgtatgcagatttaaggcctgatgttttagttcactcattcaaattttaattaaaaacagtacataaaaggtgctagttgctggagtatgatgagaaaacaaaacagtaacaagacaaaaactgaaaacatgtttcctatccttgtgaaacttactgtcaatggggaagacgtacactcagtcagagaaatgttaatatttacaacgtaaagtaatatttacattatctgtattcagaaagagaatatcaaggaagcctattctgttggagtaaagagcttatgcaaagctcctattgtgggaaggaacagaaaggccagggtaactatatctaagaagaaaattacaggctgggcacagtggctcacgcctgtaatcccaacactttgggaggccgaggcgggtggatcacctgaggtcaggagttcgagaccagcctatccaacatagtgaaacttcatctctgctttaaatacaaaaaattagccggacgtggtggcgggcacctataatcctagctacttgggaggctgaggctggagaatcgcttgaacccaggaggtggaggttgcagtgagctgagatcgtgacactgcactccagcctgggcgacagagcaagactccatctcaaaaataaataaataaaataaaataaataaataaaaaagaaaattacggtgctacaagacgaggaggaactacacagaagcctcttcattcaagaaatgaaagctcctgagttcggatatctatcttaaaagcagtagtatgctattgaagaattgtaagcaaagggtgtcttgatcacattcatctgtcaaatagctctttattggtgaggttatgagaatgtattgaaagtaatgtaatcaaagcaaaagaggtcagttgcttggattaagggtgttggctaagaagataaataattgattcgtatgttattctgggacccctagaagccaaagaaaacggaaaataagaccaattataaaattcttattttcagagacaagaaatgccttcaggaaaagggaatttttttgtataattgtctactaaaagaaaatgttcacttatgactttagtgtatatagaccaatttatttagctttaaagtgaaattaatttcaggatatttggtagtaagttttagcaaaacctaaagaaaatagtaaagcacacatttctgttattgatacataatgatcagatatatttccatgataaatgtgatattataaagcacaacttttaaaaaacatttttctagagattatgccttaatttcagcctgtggaacatttctttaggagatattcatggctgctctgtgtccaactacatttgggagtcacctcatactgaatccttttatatactgggtcacttgcaaaggcttaattgagcatttgactgtcatatgccacagaatggatcggacactataaataaaacacaaaagagagtttgtcttttctgggcttcatcttcttaaaaaaatcagctattagacaagcatatgtaagtagtcaagaattatgataaattttctaaataaaaataagtgcatgagagagcgtaagagtatttatttaattcaggtttgggatcaggaaggtctcactgtggaatatttatctaaaatgtaaagggtgaaccaagaaaacagtgatgtggaagagcattagaaaatctggaagaaacacatgtagctgaagcaaagattatgcttattttgaagaaccttttagctgcagtaaataaaagacaccaaattacctccaattctgtaaagcagccttcatgactattcttcactttgttcacaatttattatctccagcccgtactaaatagataacatcatctcctacttcactgggggcttgaagggagaaaacagtgaactaaacttttacaagacattatttgtccagctggaaataaaaagtagaaaaaacatagaactttctatgtatagaggttataaagaccttaattgctttttaatttgtttagttcatgcatcctttgtcagtctgataaaagctgtgggactcctcagaaaaatacacagtgaatatcctttacatacaaccttttacataaaaatccagcagttcaaatgctcctgcaatccattcataagccattcataatccattcctaaaccagcttttggttaagtatccctgctttcaagtatcttgataaaatagtaaaaggaccagaagatacataaatataaatagaaaagtaaatagaagtgtgtgtctgctttactagaattttgaaatatcatgtttaaactataaattttaaatttagtttatggcttaagtacagatcatatattcccataaatgtgagtatatacatttatgtgcaaaccttcgctcacaaactcatatgcttagtgtttgagatttctcagtcctggactgagagttgggaaaaagttatgttttctttaacattctctcatagaaccaaaataataggagaatcagaaaaacataggcctttacattttggcttgagatcagcttctcgccatacctctagtacctcagacaaattacttaacatgtttgtacctatattttatctactttaaaatagaaaagaatacctaacacaaattgttcttatgaggataatatatgaacattgactgaaagatttaagctttttttacttaaaattatcctgttatagatagccttttctcaagaagtacataaaaataataatagtaaagctttgtgaccacaaaaagctacctacagtatatgtatgatgtttaacatatataacttgatatatataatatgacatatgcttgatatatataattagacatatgcttgtctaatagctgatttttttaagaagatgaagcccagaaaagacaaactctcttttgtgttttatttatagtgtccgatccattctgtggcatatgatagtcaaatgctcaattaagcctttgcaagtgacccagtatataaaaggattcagtaagaggtgactcccaaatgtagttggacacagagcagccatgagtatctcctaaagaaatgtatatatataatatcgagttatatataatatatatgttataatatagaatagaatattctataataatatagtatagaatagaataatattctatactatcatttaatatgaaactcacatagactatatttgtagctgtgggtaaatacatgtatgtaattttggtatatatacgtggcttatgagggtttttatggagacatgaatatggtgttaactaaattattataagtccaatgagctttgtgagatggccagtcgaagcaaacaaattccatgtatctccgaagccatttcctctagattgactgaaaaaaaatcaatttcctttaataaacatattttacaagctttgtagctatcacttacttcgtggttaaagtttacatctatggaagattacacagtaactttgtgctcacatgattgagtatcttaggggtttttatagatacatacttaaatatgtcagggaacttcatagttgtatgattggatgtactgggaacttcttgctccttctccttaatttgtgaaatcaagagacagagttactgcaaatttaaacttgagtaagtcctttgctctacttcatttttctcccgagaggcttctttttttttaaacgtccttttgtagaggcaaaatgtaaatattctctgaactctacttctgtatcttaccgtgaagaataataattagctcattaatttcaatttttgtaatatgcttaggtcaacaagattacttctaagggctcctcatcaaatacccctgtgtactttaggttcttttacttttagcaaggctgattcaaagttttttaattcataacttttttaaaaatttttccgagagtcacattgtatctcctttatactgacgtttattatcaggctgtttttttttgagatggtgtctcactatgatgcccaggctggcctggaactcctgggctcaagttattctcccacttcagtcccccaggtagctgggattataggcgtgagacacaattcctgggtttatcattttgtaaagctggagcaatcagttaagaatggagaagcaacagggccgcacggtggctcacgcctgtaatcctaacactttgggaggccgaggctggtggatcatgaggtcaagagatcgagaccatcctggccaacatggtgaaaccccgtctctactaaaaatagaaaaattagctgggtgtggtggtgcgtgcctgtagtcccagctacttgggaggctgaggcaggagaagtgcttaaacctgggaggcagaggttgcagtgagccgagatcgtgacactgcactccagcctgggtgacagagcaagactctgtctcaaaaaaaaaaaaaaaaaaatgaattgagtagcaatagatatcatgagcctcctcatggcgccaatattcgtttgaacccgccaacttcacatttagatatatgtgtctacgttgctggatgggccaggctatttgctcatctctcagttattttactatcctgtttcatctttttccataacactgttacactcacctttttgtgtcacttttaccagagccagtcattaatgaacaagaaatgtctttatttcatttcaaaaaagcaaaatatttctttgaaaattaaacagttaatttccaagccactcattaaagttattttattataagttttaatatcagaattataaaaatatttaatatgtcatctggtaattaatatttattcttttttttgagatggagtctcgctctgtcgcccaggctggagtgcagtggcgcgatgtcggctcactgcaagctccgcctcccgggtttacaccattctcctgcctcagcctcccgagtagctcttagcagcttcttaattaaagaatccatagctctctaatgcacatacgattgtgacatatttattcgttactttaagatcctcccccagtgttgaattctaccaattgcaaggtgcttccatggctttggacaaagtacagaagaattaaataacttcacagccttcatggaattcacagtaaggcagatcccatattaactcaattaaaatatatttagtcaaagccagatgcagtggctcacacctgtgatcccagaactttgggaggcggaggcggatggatcatttgaagtcaggagttcgacaccagcttgatcaacatggtgagacccctgtctctactaaaaatagaaaaattagctgcatgcctgtaatcacaactagtctggaggctgagacaggagaattgcttgaatcctccgggaggtaaaggttgcagtgagctgagatttcaccactgcactccagcctgagtgacagagactccatctcaaaaagcaataaaaataaaataaaatatattgagttgaatactgaaataggggtaactttgggaagctatgggccgcaaagcagagaatgatgcattcagtttgggggagctaagattagtttcgtaaaggaggtgacatcttgaagacatctagaatttcaatagacatagaaaaaattcatcgtaagcagagggactagtgaatataaagaagtcataaagatccaaaaagaactcagaaataatcaagaaggtgagggtagctacatcataattataagagccaactttattgagtacttcctttgtcaccatgtgctaagttctgtattttaatatcctcattgaatgcttgaaataatttctatgaagaaagatctgttttatctttattttactgggaggctgtgaaatatgcctaaggtcacacagctatcacatggcaaaaacaagattcaaacccccacagtttctaattttaaagcctcagcataatgaacacagtattgtactgaacagaatgaatgaatgtgagtagaaaagacatttctgagaacaaagctggaaatgtatcatacaaatcaaataaacatttcttgagaaatccttggggaagagggcaatataacctctcaaacagtagccagaatcatcaacacaaatatgtattttaagttctcacaattggtctcgccatatgaactaaatgctagatatttacttgcttaatgctaccaatgaattttcaaatctttccaaggtgttaataattttattgcttttttataccaagagcaagaatcaaatgttagttgctattgatgtttacattttaaataacaactttaatttagcctacaatatttagcaattacacaggaatcctctgaaagcttttaaccagccccagaagtaaactggctttggatgctaatctcttgagctttcctgactgacaagtttcctccctagaggaggggaattggcctgtctcctaaattttgcatggcctaaagcagtgagtttagaagcacctgtgtttcctggcaacaaacataacatttgtggaaaagtctaattatttaaattcctctgcatttttctaattgaggataaagtgctgcattctaccttcgcattcttattttattccttggccctttaaataaaaaaatacataaaatgatgtggtcagctaaaatatattggacaaacaaaacccccttcctttatctccctctatcgctctctatgtatatatattatatacatatataaaatatatataaacatatatatgaaaacagatatttgtgtgtatatatacactaagagatattatagtttaaatattttttaacatacactttaaaatctaacagcttggattttaatattgggtcagtctttctaaagtgtttaatattttagtttggaagtattaattagcaattcatgaatgagtaattaaaagtgctttagggggcctttcacatcctataataaataccaaaccttttaccacatttcatactataaaatcttggaaccccattatataactatgagttattaatttctgttacctacttttaaaatgggaacatatgttattaacaggtgttgctttgaaatctatattagcaaatgttctaccttataattagtttttgacttatcacaaaaaagtattttattttttttaattacatagtcacatttcaaggttaactttaaaaaattctaaattatctgattttcatgggaaagagatttgatatttgtgccttagcattttggtatttttctctttctgtatagcaaacctttgaatgatagtctgtctgaattcacagtgaagaaaatgatcagaatattgactgtcaacagataatttagaaggttcaatcctatgataatcagggatattttccttatgtaaatgtgttgatttatcaagttcagctatgtcattgattacatctaggcttcaggccttctgtgaactgccagctctactcaattctggcttgtgaatgttatcacatattttagtcaaatcagaggttatattatacacatctgacatttttctctttgtactaataactttttttctttttttgtttttacatcatggcataagatcaacactaaattttaggagtgcatagtaagtattaccatagtgtaatgctatgccaattgttttctaacttaatatttgcaaaactgggttttatggttgtttctatgcgaattgagtgcctctacagaattttatccctgagagtatatgagtggtgagtgataagagatactgaatgtctcagaacatactagcatctgacagcctattggtaagatagtgtaagtaaagaggataaggaaaatctgacttgaaaggagaataaaatctgattggacagtctgtagccaagtttgcatattatggatttacaaaatgaggttgttttgaattcttgattaatgaaacataaactgagttgttttaatattgcgtgccatttgaaataaaatgcattttgtcacaaccctagaaatgggaggttatgtgttgtaaaatattcttgttcccatctagaagacaccatattttatagagaacagtggctgaagcttgttttactaggaacaagtatggtgtaaggaaataacaataattaatactggtggcacttagtgctatagtaaaagtaaatttctaattagaaaataattaccataaaatactgaattatatctttgtaaggcctttagaaattgaatcactaatttaatatataagtaagtcaatattatttttatgagaaaatggacaacttacgaagttgttgttatgttttcaggccatattccatttttcaccaaacaagttatttccctgatacactcacttaaatcatcagtaatacatataggtttaaaaatgttttgtacaattctgaaagcctatcttagtttaatgaaacataataccataaagcttccctttcctccaacatttgagctacaataaaacaaccttgtacaactgataacaattaactcaccacccccaccccattgcagtcattagaattcattactaaaagctcatttgtttatggtaaaataaagtataagggttttgaaaccaccactgcaaaattaggactgagacagtgaaagagatctaacttaactgactccatcttgcttctaacctccactaatttatagtttatcgtttaaacaaacatcataacagccctttcccaaagcagaccttcttgcctggggactagattgcctctgtaggactaacatcagccacagtattagaaattatggtttaggagtcatgcagctggaggcaacaagattctgacccccaccaaactgctcctaagatcagtgcttgagataatttgcagaccctgcacttgatggatcagctggcactacccatatcaataaactggctcatctgatcttgtggcctccacccaggaactgactcagcgcaagaagacagctccaactccctgtgatttcatctctgaccagtcagcactcctggctcactggcttcccccgacccaccaagttatccttaaaaactctgttccccgaatgcctggggagaccgatttgctgatttgagtaataacaaaactccagtgtcccacacagccagctctgcatgaattactctttcttcattgcaattcccctgtcttgctgagtcagctctgtctaggcagtgggcaaggtgaaccccttgggtggttacaaatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataagggtaagaaattcttatcagtcaagtttctggtctctctctctctctctctctttctctgcattgttaaatagtaaactatttgtctcctctgcaagggtttggttaatagaaagaaggatttgtgagactaatcttagcacatctgatgtagtttgtgctaagaatttgtctttctgtgttatgtaatggagagagggatatcacgtgatagaacgtgggttaggacacccataagtctgcttttcaagtcagcttgggaggctggtcagctacaaactttgctacaggtccctgaaaccaatactctatgaaatttctctgtcttgttttgtgtccttaagagcttaaccttgtgaccatgtggggatactttcttttggtttctaccatccagaggacaggaattttggggttcatgtcatagttactcctaagatttttcttgagcagttaaaagccttgcaagcctgaaactggcttctctaggctccttctgggaaaagcagtagaaatttctcaacgctgtatatagctcagtagctaaggctttgtcttttgacagtggtggcctgggttcaattgttggcttctggaatgattcctttctgatttgttatttgtgtagctttgccatttattaagtttcttttctgatttcctctcttgaattttcctttctctggactaccttgtggagattctaaatcttgtaaaaagaaacttcttactatgtctttgcagcacctaggaggtttcctttggtaaagttcagaagctaaaaatattgtccacttggcatggctaaaattaggtaataagagatctaaaagaatttcttttttaaagagcactatggttaaaagtcagcttaattaagagtggataaacaagctatagatatatttaaaaggcctttatgtttttctcttcttggaacttgtttttttggaaaaagttttttcttctcagccgactgaattatttttctccatttttttctcttttttaatttttttgtcttgccactcttaacgcacacgtgagtccctaagataacttctggtagcctgggactcattgggaaaaacagaggaggcaccacagaacccgttttagggaaaaaaaaaaaaaactgttttccacatgaaaccccaggaattaaaaacagatggatccctctcaaaatcaaagactctgctctgtttttcattgtgttatctgatggttttgagttttggggatatcagaaattacttcacattatgagggagctttagtgtgtaataactagataggaaatatactttaagggatggctaatggtagttatacagggatacttgactctttgcacacttggatccagagaagcatgcttttggtcacccggaagataaggaaacattcctcaccctccactgggagatcagactcccatgaaggacgggctgattacaaaatgggctgattgactttgggttgccttgcaatgaaatgcagggtatggccgggtgccgtggctcgtgcttgtaatccaagcactttgggaggctgcactttgggaggccgaggagggcggatcacttgaggtcagcagtttgagaccagcctggccaacatggtgaaaccccgtctctaagaaaaatacaaaaattagccaggcgtggtggcacatgcctgtaatcccagctacttgagaggctaaggcaggagaatcccttgaacccaggaggcggaggttgcagtgagctgagatagcaccactgcactccagcctgggtgacagagcgagactccgtcttaaaaagaaagaaagaaacaaaaataagaaaagaaatgtagggtagaagcactgtactgtcttctcccgtagtatttctctccttttgggttgcagtataaaatggtgcccttaatttgggagttctgtctttgccttcagctgtgattaagccttagaaatgcatactttcctggccctgttcctccaaaggctccaccctgaagccagtaatctgattaagaaactggcaaataaaaagtcttatcagtgccaaatcttctgtctgtatttacatgtgtttttgtgtgtgtgtgtgtgtgtgtgtgtgtgtgtgtgatgtttataaaagagctctgattaattggcttggaaaataagtgcttaaataaaaaaatattttgtcagaaaaatagaaactttgatgactttttgttcacatgactttagtaatcttttggcaataaagacaattttaaagattattgttaaagtaaaatatcttgaaaatgtagacatttggtctaaattaaggtcagctatcagatttgctaaattctttaaggtcaaactgtttccttgactttggaaaattgttcaatttatttactttggagcattatattatagatgaggcctggggacacgtggagagctatgcccctagctatgctgaaaagagtcagaccttatcttcacttctgtctgatgtcctaggctccatccctagcatataattaaaatagcttttttatcaggtttttcactaaaaatcaaagttgctaagagttaacattgtaacatgaaatcgaggttactggagaaacagttttacatacaaggtgtgtagggaatgtgtttttggtgaaagataataaggcataggaatatggcttttgttgaagagaatgtaattttgtctagttcagaggttttaaagactgtcttaaactaaaagagtaacggaacgaaactgagggtttaagcaaagtgaaaagggtttatacagggttgatcctgaaaaaaaaaattctgtgggtataaacaagttggctaagatttgaaaaaggttatttagctttttctataggttaaaatattaaagtcatactgtggggccagaatctgggcccatgtgtccaaataacagggtcttcttagaaaattgatctgctgtttaatggaaaattataaagcgttctaaaaagtttatgagaatgtcaccttgtggtcaaactaattaaaactggatagatacataaaattttatttaaaaactagctttagcattaaagatgcactaatgcgaacatgaaatttggttttctcttttgaagacgatttttttgtaacgttaaaagataatgaaagggtttggctttctcctttgggtaaatggcaggggaaaaggggagagagaagagacaaattcagttatcctcatgctgtctttattgggtcttgtttggaaagctaagtctcctctgtcagaataaaggtttttcttttaagattttggagttatcgttttggtcaaatgaatgacttatggtgacctgggattctattttgtgatatccagtgttttaaacctttgatatttggcaaactttccaaaatcaaattataaattatgtctctttctggcctaatcttttagatattaggtcctctaaagtccaaaaatgacatttggcgtattttgcataaaaatcatacaggaaacattgtcaaatatgaaatggtgtttggctttttgggggctatatttgtgtaaatatatgattgacatatgttctgagattatgtaaaactcctataattctaatatgacttagtatatgttatcagtaataattgtaattatgttaaatggctatgtgccacagaggtaacaaatttccttgtcgattgtgtctttaactctggctactctacaatgtttgtgtcgtccacaggcaattgttgtctcatttttgtcctcttaaaagatggttttataggccgggcatggtggctcatgcctgtaatcccagcacgttaggaggccgaggtgggcagatcacctgaggtcgggagttcaagaccagcctgaccaacatggagaaaccccatctctactaaaaatacaaaatcattcctgtaatcccagctactcgggagaccgaggcaggagaatcgcttgaacctaggaggcggaggttgcggtgagccaagatcatgccattgcactccagcctgggcaacaagagagaaactctgtctcaaaaaaaaatggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtggtaagtaaagaatgtcactttctaacaggcccaggaaccccaagttatcttgggacctcaagaggagaggactttggtcaactcataggtatttgagggtacaaacccatggctgggctcggctttcaaaaagtcttatctgagattcttcatggaacagagttccatcaaagccaatttaaaaagcctaagtgaaaaataattattcttgctgcacttcatgcaaataatcaggccaagtacagtaagactaaaatgcattttataagcaaatcatttctatcatgatttgtttttaataaaaatggggactgaacagagaaatattatgcttcaaaagaaaatctatagtaaactattagctattcttgaggttaattcttcagtttagactaaattctaaattgtttgtgggttagaagttcccaaactaatgatttcaaatgtttgcttttaaaattgggaattgtacttctcatcctaggactcattataccttatagtaggctattcacataaacactgtagtaaaactatagatgagagtaataatgtttctgccacgcaagccttggaagcccaattaggcctgcatgaatccactcaaacagttgcaaagcagttccactcttctcaccttggagttcgttcccattcccgctacttcccccatcagcaggaagaagccagagcgatcgacggccttttcccatctttatagcctataccttagggttaaagtgttagaaaacccaaaggaagggattgaaaccacctttgcaaaattaggtctgagacagtgaaaacaatctaacttaactgactccatcttgcttctaacctccaagctgtcttcgttcattcctgggcataggctgaactaactttgggagaaacttagtttacagtttaaagatggtaacagccctttcccagagcaaaattccttcttgcctgggacttgcgtttgtaggactaacatcagccacagtgttagaaattatggtttaggagtcatgcagctggaggcaacaagattctgacccccaccaaactgctcctaagatcagtgcttgagatattttgcagaccctgcacttgatggatcagctggcaccacccagatcaataaactggctcatctgatcttgtggcctccacccaggaactgactcagcgcaagaagacagctccgactccctgtgatttcatctctgaccagtcagcactcctggctcactggcttccccccacccaccaagttatccttaaaaactctgctccccgaatgcttggggagactgatttgagtaataataaaacttcggtctcccgcacagctggctctgagggagttactctttctctattgcaattcccctgtcttgatgaatcggctctgtccaggcagcaggcgagttgaacctcttgggcggtcacagttttgacctagtaaagctttcattttcttgctttgccctatggcctaatttataatatacataaccaaaagccttagcttctagtaaatagtatttattaaagtgctatataaacgttacattttagggtaaccaacttttcttgttttatttttgtttgtttttgtttttcaggaatttctcagttttaaaatttaaagtcccatatcccacaaacctgcttagcccccaggcacaccagacactcgatcaccctaaagttctagtttattttgggatccttgcatcccttaaaattacatacaagatgttgggtatacatacatactgcaattgccatcaggttcaccttgcccactctctagacagagttgatttatcaagacagggaaattgcaatagagaaagagtaattcatgcagagcaggctgtatgggagactggagttttattattactcaaatcagtctccctgagcatttggggaccagggtttttaaggacaatttggtgggtggggagcagccagtggtcagaagtaatgattggttggatcagagatgaaatcatagggagtcaaagctgtcttgccctgagtcagttcctgagtggggggtcataggatgagatgagccagtttattgatctgtgtggtaccagttgatccatcgagtgcagggtctgcaaaacgtctcaagcactgatcttaggctttacaatggtgactttatgcccaggagcaatttggggagaagcagtatcttgtagtctctagctgcatgactactaaaccgtaatttctaatcttttggctattttgttagtcctacaaaggcagtctagtccccaggcaagaaggaggttggttttggggaagggttgtcattgcctttgttttaaaccataagctataaactaagttcctcccaaagttatttcagcttacccccaggaatgagcaaggacagcctggggcttagatgcaagagggagttggttacatcagatctctttcactatttcagttataattttgcaatggtggtttcaatacctgaatgcattttcgtaagacaaagcttcaatgccaaaacatctaagatatcccaatacggtattaattcatttgctcggtattaattcatttgctgttgctataaaacagaatacctgaaactaggttacttatttcaaaaaggaacttatttcttacagttatggaggctcagaatgtatctgcacaataggttcttctttcctgctgcccaggtagagctgatttatcaagacaagggaattgcaatggagagttttatacatgtacagccaccagctaagcagaagatcagagttttactattactcaaatcagtctcctcaagaagtctgaggctagggttttcaagatcggtttggggaaaggcatgtggaaagctacgcaataggtgcttgctgctgactggtagggattgcaatcataggactgtgggcaagggtcctcctgtgcactgagtctcttctgggcggggccacaggagcagttggcaggtgcaggtggagccatcagtcatcagacatgaaatatatctgaacagatatctcaaaaggccaatcttaagttctacaatagtgatgttgtctgcaagagtagttggggaagtcgcgtgtcttgtgacctctggaataatggctggcaatcctgtatgtctacaccgcagcagaatttagtttcccctatcctcctagcctggtggtctctcattagctctacaaacgcggttgagttttggggaagggctattgtcatttaaactataaatgtctcccaaagttagcttggcataagcccaggaataattaagagcagcttgaaggctaaaggcaagagaggagttggctagattagatccctttcacttccatcattttctcaccgttataatttttgcaaagaccatttcaagaagtcccaggtcaaaaggacacatctggtgagggccttcttgctggtgggaactctctacagggtcccaatggcctggggcatcacatggcaggagggctgtgtatgctaacttgctagctcaggtctctcttcttatcaagccaccagtgccattcccatgataatgcattaatccattaactcattaatccattagggcagaactttcatgatccaagtgcctcttaaaggcctcccctctcaatactgccacactgggggttaaattttggaggggataaatagtgaaaccatagcaaccactgaatcaaaggagttaaatgctatttttaaaaatgatgctaaaagacaaaaaaaaaaaatatagtgttaaaagaaaaacttgagccaaattaaagttaaaggagtttaattgagcaatgaacgatttgcgaatcaggcagccctcagaattacagcagattcagagagactccaggggtgccttgtggtcagaataaatttatagacaaaaaaaagtaaagtgacatgtagaaatcggaagtgagatgcagaaacagctggattggttacagctcgctgtttgccttatttgaacacagtttgaacaatcagcagtgtataactggctgaagaatggcggctgggattggccaagactgagtgattgtcacaggcccatactcctaagttagtttttcaatcttgtctacctattgagataggttgtagttcatccacagggactcaaatatagaagtacggagtccttctcaggccgtatttagtttgctttaacaatagactttatgggaaaatggtattttgttaaatgcaaaataataagttagagaaacactttagtgtttataatttttaatattgactgttagccttagctgtttatttatttatttatttatttatttatttatttatttatttgagacagagttttgctctcgttgtccaggatggagtgcggtgatgcgatctcggctcactgcaacctccgcctgccaggttcaagtgattctcctgcctcagcctctcgagtagctaggattacgggcacccgccaccaagcccggctaattttttgtgtttttagtagagacggggtttcaccacattggccaggctggtctcgaactcctgacctcaggtgacccacccacctcagcctcccaaagtgctgggattacaggcatgagccaccacgcccacctgccttagctgtttaatatgtaactcatggcttggtatagttcctgagatttggagaggcaaactgaggtttgaatcctgtcttcaaacttattggcagttgggcctgatcaagttgcttaacatttttgtgactcattctccttacatacaaagtggagaaattttgcctatttttaaatagaattgtacaggacagagaaaaatgtattttaagcctcttagtgctttgtgatatatagcaggcaatatttaaatggtaactattattattgataatagtaagtatgtatttatgtgcttcacagttttacaattaaacatgtccctctcagggtttcttactatattcttacctagagctgtgacatattaaaccaccttgcaccaaaactgaacaattggtatactgaggataaacattacttttttattcagtagatatcactggataattttgttataaatctctgacagtaaagtgaaagattatgtatatcagttaaaactgataaataacattaaaaagaaatttctgaattgaacatcttttgctctaaattttctggccaaatagggatacctcaaaggaaaatggccggtgaatttgtatacagataattaaatagtagttttagtcagtaaatcaggaggtccaaataataagtagaaccagggacatagcatgatggaaattatgctgcccagttttcaaaaacattgatggtaataaacagctgtgtaacataaaagctggtatgagaacttggtcaaattctttttacctgagttgagaaaaggtatcatctccccatattctactccaaactgatgaaatgctcaccgagctgctccgtagcctggctggttacctcactgaaatttcacccttggaggccttatgaccttttaacttattccacagctagattccaccattatccaaatcaatggtgcatttacaggtgattcagaagttatttagagaagattctgacatgttcaataaaaattccaaatttctcaggaattacttttagacatctctaaatgaataacagagaggttatgtgaaatccttgtgtaattatctgtgcccagatttttttgtcgttgtttgtttttggtttttgaaacagagtttcactcttatcgcccaggctggagtgcagtggtgcgatcgtggctcactgcaacctccatctcccaggttcaaatgattctcctacctcagcctcccgagtagctaggattacaggtgcctgcgaccacacctggctaatttttgtatttttagtagagaaggggtttcactatgctgaccaggctagtcttaaactcctgacctcaggtgatccgcctgccttggcctcccaaagtgctgggattacaggcgtgagccaccgcgctgggcctgtgaccagatttcttaaccatcacatgcctttggacttgccattcaatgttccatttagtagattttgatacattgaaaaatcactatgaacacattttcaagtctagctggcttcatttttgtcctctaaatggcactaaatagaatctgtgattgtgacagtgcctttgctttaatctaccagctatttttgaaagatatataacttaattgaaaaatagtacaatcttttcacttagaatctttacgaaaaatgtaaaagatgctttgccagtctgaatagttaattgagtttgactgtaccgggtaagatgcaaaagagtgtgtctatggcaactctttatctcataaaaaatttaaagggcctttatttaatgtgactccttttaaaattcatttaatggcgtaagtaaaactggatatataattagagtctaagataaaagcataataattgaaataagataatatgaagaagctcacacaacaatgattgggcttcaaatgaatatattctttaagctcagctgaactcttgtaagttgtattttttcactatgatgtaataataatggtatgtggatgacaattatactactttataaatgtaaggtgtcttatagtgtactaggatctttcctatgcattatcaaatctgaatctccaattagccctggatatttgtatatccttttttttttttttttttttaatcaggacagagtctcactctgttgcccaggctggagtgaagtggcgtgatctcagctcactgcaaccactgcctcccagatagctgggactacaggcatgtgccaccacacttggctaatttttgtatttttagtggaaacggggtttcaccatgttggccaggcttgttttgaactcctggcctcaagtcatctgccacctcggcctcccaaagtgctgggattacaggtgtgagccaccaagtccggcctgtatgtccattttttagaaaaggaaactgagcacaaagaggttgagtaacttgttcaagatcacataattagtaagtgataaagtcacactcaaacccaggtattctaacttcaagtataatgttcttttctctgtgttccttctttgtataatagagagcaatgagtatgtaggaagggcagaatagctgcacagatctttacaatatgtctcacaataatgctgtgctttcaaaagacttgatttaatcattttgtttcctcattcactggtctattcattcaggctaagggggcccttttttctagatagatttgctttcaccatttcattcccttgtcaatattcgccatcttagaataattgtgttttcattctcccgcttgaaaaaagatgcttaggtaattctttatttaagaagtaaagaaacattatcaatattgatatagatatgaacatatatatatatatatatatatatatatatatatatagagagagagagagagagagagagagagagagagatggatagatacagatatagatacctcaaatccaggaagaaggaactagattttttaattatacaaaaataaaatactcttttttaatttttttcttttaccttttgtgttctttacataagatcaaatgaataaatacatttatttaataaggaagcttattggtagttcctgtagtatttactgtctattaagcatcaacctaggaattgtaccataacttttgtttaaatacaattcttctattgatgcagtaagagctgtcagtcatagtgctgggaatgccagaggggaagtcatccctgacaacattttttattgcactattaatacgtacaagttgacgttcaagtgtgtgtatgtatgtgtgcgtgtacataggcacacagaaacatcatatatacatgtgactacgtaaaaaaatacacttaaacatatctgtttactctgtaagtgaataatcatttatttcaatgtttagatgagattttaacatattagaatggcttcatttttctttctaggcaatctgctagcaggctttttccagcaacctattcttcccccatctttttgatattataccaagatttctgcctccatttttgttgatgtaattatcccggcataattttgaaaaaagatttcctggcaatgtaaatccacaagattgttgatatggcttgagctcaaatgatgcttctatccgatttgtttacctttcagcttgagcagagttcttgtttcataagaaaaacaggaagagatactatagtagagaaggacttttatggatggttttattttaagtaaatattgcctgtaagggatccaggaattttagtgtttttcttggattccttaaccataatacttagcccagagcaaaactttctctcaaatgatggtaaaaaatctaattctattaaatcctgattattctgtgagctaccttggaatacattgcctatgagtttttctgctaagaaatggacttcgtttattgctcattttcccaaaatcaaggaatgctgttgttcttcaatttagatagatgttgacaaggtcctcttcatagcagcaggtgttaggctataattgctcattatagaattatgttttgcttgaaggaactcaggaaacaagaaaagcatgttttctgtgtatatgaattctggttgaaaaattgaaagaatgacactaggaatagtatgtaaattggcagaatttgtcatttcattgtgcaactagtattttaaaaggcaataaatcaacgtgaacatccttgggaaatcagtctccttcttaggcctaacttgcaaagtacccccttaccattgtatttttttaagatagaaattgagattagagcaacacggggagcaaaatattggcagatgaacttgttgaaggagatgaaaaacaagaagctatagaaatagattggccaatagtgctgagcaactactcaactgcaaaaatggcttgcttttccaagcaatgtgtaaagcaattagcaccaacgtttttattagtttacataaaataatattactttgtaaacacctataaacagagattacctagatagcctaagactattattaagtacaataaaacgttactggtttaaagtaataggtatagaactttgtattgtatggtgcacattcacataactagagaggaaatggaggtctacaagtcaaggttgaattacacacttgtaatccatccttaagggaaaaagcttcactgatcaagatggtactttgcacaaccttgccaattgtttcacaaagctgtaatgatgccacaaataatctttcacctcccatacctaagtaaaccatatttgagttattttctctgctccttcctatacctttcctctttggcatcacaaagtcagatttttaacctacaggttgacataagccaaaaatgttggaagattataaactgcctctctttctctcactgtatgtgttgtgtatatgtgtgtgtacacatatataagcacacacatagatagaactcacacggaaacataagcacatatctacgcactgttgttttgctaccatatccagtgataacgtttattttgaattacatgtattttttttctgaatttaagagtgaaatgaaatagagttttgttagatatacagttattacctatataaaaatgattctgtgcatacttccttggcaaagtacaatacctcctccgctgtcactgccaatgcacaggtgttctttctcctggctgttagactcactgggagaacttagaaaaatatttcagccacagctttactctagcctagatcaattaatcactaccttggccttacaatctactaggcagtccttcccaaactctagaatacagcagaatcccctagaatgcttattaaaaatgcagattctaaagccccattctaaatgatattcttctggtaggtctttacaagtcatgtattcctggggtctttctttgagaaacacaactctaaaaggtctttgttattcccattctgggttttgaattctttctcgaaattgtaacaaaatatatgtactgaaatactgttcctctaacaatctgaagaaattttcagcactagcagcacttgttggcactattgttgttattttgtttaatatttaagacaactaaaagttacagtaatttataatgagaatcagtattatggaatcaaccattaacagttcatctcactaaagaatttttatttttattatttatttatttacttacttatttttgagacagagtctggctctgtcgcccaggctggagtgcagtggtgtgatctcggctcactgcaacctccacctctcgggttcaagcgattctcttgcctcagcttcccaagtagctgggattacagctgcccgtcaccacacccggataatttttttttgtatttttagtagagatgggatttcaccatgttggccaggctagtctggaactcctgatctcaggtgatccacccgccttggcctcccaaagtgctgggattacaggcgtgagccaccgctcctggcctcgctaaagaattaacatcatatgttcactagtactgaggttagttcccaaacactgcactaaaaaaatgaatgaaacaaatgaatgaaaatgtgtttccttagccatattctaagaaaatcacctctttgattattgtaattggaaccatctcttctttctttgcctggaatctttgtaacaaggttatcttctttcatgtcccattccaattagtaatcatttatttctattaaggcttttataatcattcggagaatccacactctttgtgtctgcagtcgctgagttcactcattaaatacagaattttcaacaaccctatttccatcttcattgttattaatacttcaaatttgcttctgttcagaaccacgcacttgtaggatcgagtaggtatacgtgttatccgtacacactctgaaaaactccctgcagacacttactgaacaggaattgcttatttaactgtgttttctgtctctttcatacatgttctctctctactgaagtgattgaaggatgacaaaggtccttatgggtgtttgatggcctgtgaatagctgtcggtctacgaattccctgaaaataatttctccacttgtatgaaaataatttactccgtgacttttcatgttgtattgtcaatcttccttctggttgtatcaggcaggagtcattgttttacatttcattctttagggggcctatgcttggatttctcccattgagaaaaaacaaagcataactctgacataatcgttggtgttaatatcatgaaaacctggaaaaactaaaggcaaggcaaaaaatatgcattcttatgcatgctttatgtgcactatgcccgtacataaacctggcagaactttaggcagaattaaaggtttaaatgggcatcatctatcctctataggccttttagtgtgcttcttatgtcctgaggaccataagaagatctaggagctgagtcctacctaccccacattgctggtaccgttgggggctctatgccattctactccagccagcttcctaagattagtctattacttttgtttcctttttttcttttctttttccttccttccttcctttttttttttttttttgacagagtctcactgttttgtccaggctggagtgcagtggtgtgatctcgtctcactgcaacctctgcctcccaggttcaagcgattctcatgcctcaccctcctgagtagctgggattacaggcgcgcaccaccaggcctggctaatttttattttagtagagacgcggtttcatcacattggccaggttggttttgaactcctgacctcaagtgatctgcccgcctcggcctcccaaagtgctaggattataggcatgagccactgcacctggccttattactctcgtttcctagacattattccacccttcctaatacttagctacctacttttgcttccgtttaaccctctgtaacttgttttaaggtggttttttttttttttaaatcctttggctatgtatgttcttataaagcaaaatttagttgtgtcaattcatgaaatcatattagcattcacttagaggagagtgagaaatgtttcctgctcatctatatagcattgcccatttgcacttagttttgatatttgaggcaaatccttcggttttattgtctaaacacacagttgtaattctaaggaattttacaccaggtcgaaggaggtagcattgcccttgcatactattatgtagggcattgtaatatgacatctgtcatatagtgagatgaggatggctacctctttcacttaaaatagctctggccctttatataaccaaagaaaatataactgaaatgcttggcaagaagtaaagttatgaacaatgggcttccagcatttgctgtatgcctgctggcataggaattccaagcatataatgggtgttctttatataatgaaaagccaattgtgagaccggcttataatctttggtgccagtaggcagcatgtacatttcataatttcatcctaatgttttaagtgatacaaaaatgtcctttttatctactaaagtgcttcacatgttaataaatacatgtaaatttctgtaaagtgatattgtcccttaatgaatcaaactgataattgtttctatctcattaaaagtaatctatatttgaaagtgaagaactctacaaataaaaatatttaacatatcaaacatttgaaatttctaggtattgtaagcacaaatatttatggtcatatttggccagaatgttttccttgtaaatagacttggaatttttatatccactattgtgattggctgtaataatttttcaagtactgtatacacaaaattataattacattttatactaactatgggtgggggctgtcaagtgtaggtaaacaccaatttgcctcatcatctcttttgtaaaacctccaaccaccaaacctaatcgagcaagtttatgcctcctctactgcatgttagcactttttccatgttaatgtaatatttgtacacaaacctgtatcatccaacagagcttctgagaagtagagacctttgcttattagactttcagttcttacttcgtagaatggtggttggccattccatacattttattttattttattttattattatttttttctgagatgaagtctctctctgaccccgaggctgaagtgcagtggcgcgatcttggctcactgcaacctccgcctctgaagttcaagcaattctcccacctcagtctcccaagtagctgggactacaggcacttgccaccatgcccggctaatttttgtgtttttagtagagatggggttttgccatgttggccagactggtcttgaactcctgacttcaggtgatccacccacctcagcctcccaaagtgttgggattacaggcatgagccaccgcgtctggccatcaatgcattttaaataaatgaactaaataatgaatatcatttaagtgcaattctgtttacatttgtttacatctatacttattttaatcaagtatattcggtggtgtcaacaatctgtagcttaacaattttaattgaaagactctaattacatatcactatataatagttaaatagttttcttggatgaaacaaaagagagtgagatagagaaagaagtaacaattaaaggatttcattatgtgatagtcttcctgtgtttttttttccttttagaaagttgccgcaataatagaaaatgtttatttctttttcttactagtagaggtggcatttttgctatagagtgagtgcccttagttcttcatttattaacaaatatttcattctatgtataaaaagtataataaaatcatatagacaatgttacatgaaaaatgaacggattgttattacaccaggaaatcactactgtgccctatcaaaatgagtttgaagtatatatgtgcatatatatgtatatatgggcatgaatctaaggcaatcaattatgtctattttcaatgctctgtgaagaaagaaattggttgcctactgtcacattttatcttagtgatactctttcattaaaatgcacacacgaaaaaattaaaaatgtaaaatctgattttctaagtggacttaggaaggtacagggaacaagtgctagtgcgtgaagtggaaagtatgagagtacatgaagttgaaaatgtgtttgtgtgtgtgtgtattgtagcaggtcatctaggactgcaattttcaaccatatgcccaagccccggcatagagatagtgattcagttggtctggggtggggtatgggcttaggtaatattttatggctctctaggtggttctgatgtgtagtaggggcaaagaactgcctctatgggtgtctaggactgtactgtaactatcagcaattagtgagagggttctttgtaatgcctttgattattcttctagagacatatgttctgtacatcagccggggagcaaaaccagggaattccagaagtggttctcccttaagacttactctgacggtgttagtgttttcataactcgagccttaccctcattctaggaaaaattataattattatctatcttactttccaccctcagtacttaacattttaagggatttagtgaatttttccacttccctttttatatttgttgcaggtaagtcctgttgaatatcatcctcaaatacatgcatattttactgccatggtaacattttctactttttcttctatttttttcatatgtaaattatcattgaaaatttggcagagtctctggtaaccaaagtaatcttgtctgtttctgtgctactagttttattataatttgattcctgttccaaaaatgaagtacagtaataataattttttaaaactcaaattatttgtaggtcaatattaatgactttttattaatgtatatgtatataggtttaacaataagtgaagcagcttataacagtatatattctattaagtagaaatttacacataaagttagaagaactccatgtgcagtgtcctcttatgctcatatataactttctgtttcaaataagagtttcaaaactagagtctgtgtggcacagatggtgaattgatgccataatttccaatctgcttgttagtagagatatgtcatatgtttattgatgattgcaagtatgtttggtgcattaaagcttcatatttagtattataaaaaacttaatgtcatgtggggaaagaagttgctacctttctaaaaattgtagaatagccaggctcaatggcgcacgcctgttatcccagcactttgggaggccgaggcgggtggatcaccggaggccaggagttcaagaccagcctggccaacgtggtgaaaccccatctctactaaaaatacaaaaaccagccaggcgtagtggcgcacgcctgtgatcccagctactcgggaggctgaggcaggagaattgcttgaactcgggaggtggaggttgcagtgagccaagatcacaccactgcactccagcctgggcaacagaacgagactccatctttcaaaaataaatagataaataaataaaaacaaaaattgtagaataaactccttgaattccaggaagaaacaaatattgttgtccagttatgcaattatgcataatgagagttaaatgcacaaagtgatcttaaatgtacatattcaaaaatagaggttggatcaagaattcagattattcaatatcaattcaattccttctgttgtgccatttgaatcctattgccaaagatgattattcatcttgaaaaacagactcccaaattcagagttcctgcattttaatttgcccttatgaaaggaaggattctttccttttctggaatacaatcaacttctgctgagaagaaggaaagtctttattcaatactgaaaatgtgtattttcttaccgtctatttatatggacaataatcaaacttttaattatcttctcacaatacttacagatctatgagaagagttgctatctaaagctggatctttatggagaagagacatgctcaagtgtagcgaataatttttgttacatatcagtattaactaagctttgcaaagtgaatagggaaacttatatttaaaatgtcagggaaaaaaagagttttaagtaaaagggacacctggaactctaaagagactatagctctaaacctgtagctgaattctgccttagatttcgttgacccttaactaggggcaaatgcacaccccattctcagggtttcccacacacctctggaaggaacacaggagcgtatttacagctatcgtctaaccattatagaattcctggggacaaagttgtgtcagccacctttgatttgtagtaaacaggtacaaaaccgcatcatggaattatttctgcttatataatcctcttctgcagtgtctgaatcttggcacctcctctccttcctcctaaccactgcaaaaacaacacccagattaaggcatcggggagaactgaatatctgaatatcaagtactccatatatattgatccatcgaatatgcctacaatatcactactaacctacaagtgtaccaggagttacacctgcagtataacagattaaaacagccttctccaaagctcatcactttgaatgttaaaagattcattttccaccacttaaaatctgcatactatgatctgtgtataaaaagctaaaagatatatccaatttcaaatgtaatgtcatgcaagtgtctactgaatgtgtatatatctttgtaagtgtccctgagcaaaataactttcaacttaacattctttttctcttggatataaaagagaataacgtaacaagagcaaatttgcttttaaatttctgccttgatagcaagttaaagtatttagaaccaacatcctcttaaatgtataatttatataacggatgagtctagaacagcatttccaaatggaaattgtaaagaacattgatcccgtaagatgttgaatgaaaaacaaattgttaaaatgtgataatttcatttccttctttagcgagtcacaactcaaccctgaaatgttttgtagttaaaaaaattgtttaacttagtttaacccaatgtttctgaacctacgtcacaaaggaaatgtttttgtcaagtgatacataactttcaaagagattggatttttttttttttttttttgaaatgaagtttcactcttattgcccaggctggaatgcagtggcatgatcttggctcactgcaacctctgcctcccaggttcaagcgattctcctgcttcagcctcccggttagctgggattacaagtgcatgccaccacgcccggctaattttttttgtatttttagtagagaaaggggtttcactatgttggtcaggctggtctcgaactctagacctcaggtgatccacctgcctctgcctcctaaagtgcagcgattacaggcgtgagccaccacgcctggtcgagactggaattttttgaaacacattttcataaatgaattactggggtactctctgtttattaactatgttagtactgacaaagattatttgctcggccaaaatttattcaggcttcccaaccttctcatagcccagtctgtgcacattctcctaaaatttagttttagcaggccagatcagtttagccagaaaacactcatccttggtatttgattatcctggatatctgatcatgttcctcatcatccaccatcctccaggggatgactggactattttcagcaggagtctcccttacccatgatgcttcctcttaataattttccatccactgacccctaccctgttccttggttataaaattcccatttgcctgtgctgtattcaaattgagctcaatctctctcccctactgcaagaccctattttcacggtccctatacctattgagatggtcttgaataaagcctgccttaccgtgattcagcaagtgacattgaataattttttctttaacagtataaggatcgcacattaccatttgttttgaaagatggtataaaaagactaactgaaaactaatcttggctgggtatcactggcagaaattcttggtcttcaatctatgtagaacagatatttgcattttcttttgaaaatttaatacattgattaaattgtcattttgttataaaaatatgaaatgaagggtacatatgatttttaaaaatttctgtccaccatcaccaaccactatgtgaaaatacacctttgtaagactttttctattctataacataccttcaaaaccaagaagaagtatttgtaggaaattcattgcttttatttgtgaattgataaagggaaaataataagctagggctcgagcttcagaacagggtgatggttttatatctctctcaaaagtactgcaaggtaggttgtttcaatactattaacaaccccagggttccctgacatcttctattcccagcttccattctcaaaaattatatcgaggccatgagttggactcctcagccctagcaaaagattattcatttgctctgtaacccttcttgaaccccttttcctggtagctgtgcccaataaatccgacttatatatctttgggagttggagagagagagagagagagagaaagaaagtgagacagagagagatagagggaaattattttagctaagaaaatttacagtcacaataatatgagagtctctgaataagggataaaagaatattagacgagacatagtctctgccaatggtgattaagtaaacatagtcaaggagaatatggctgtgaccattagtgtgtaagtggttacatctggtgggcaatctccagtcataagtaaaataatctacgagtgagatacaggctaagcaaagatttcataattaggaccgaacaagcactaagtacaaagtcaaacactgataaattgagcttcattaaaactaagaattctatctattataatacactaataacagtgaaaagaaaagtcatggactgggagaaaaatattcacaagacgtatatctgattagaaaacttgtatccataatatataataaactcatacatatcaataaaaagacaacccattttttaaaagttggcaaaatatttgaacaggcacttcataaaagaggacaaagatggtaaaaaacatttgaataggtgcctaacttcattagtaatcaaagaattttgaatacccctatatatgcatccgaatggttaaaatataataagacaatatcaagtattggggagaattggtgcctcagctggagctctcaaatattgctggtttaagtgtaaattaatatttgccaatatctactaaatctaaatttatgccttccttatgagccagcaattcctctcatatgtatgtgttcaaaagaaattagtaggccaggtgtagtggatcatgcctgtaatcccagcactttgggaggccaaagtgggagggtcacttgaagccaggagttttagactatcctgggcaacatagtttgacctcatctctacaaaaaaaaaaaataaaataataataatcaaaattagcctgacatggtggcatgcacctgtagtcccagctactccagaggctgagatgagagaatggcttgagcccaggaagttgaggctgcagggagccgtgattgcaccactacactcctgcctgggacagagtcagaccctgtctcaaaaaaggggagaaattaagtccaccaaaatagcatgcacaaggtagttaatagcaacattttgcataatagcagaacctgatataacttgtgtccctcagaattagaattaaaaatgcggtatagactgggcgaggtggctcacgcctgtaatcctagcactttgggaggcccaggagggcggatcacttgagatcaggagtcagagaccagcctggtcaacatagtgaaaccctgtctctactaaaaatacaaaaaattagccgtgtgtggtggcaggcgcctgtaatcccagctactcaggaggctaaggcaggagaatcgcttgaacccaggaggcagaggttgtagtgagctgagatcatgccactgcacttcagcctgggtgacagagcgagactttgtctcaaaaacaaaaacaaaaaacaaacaaaaaacaaaaattgggtatatccgtggaatattatatagtaataaaaacctgctacttggaagaatatgaacgaacttcataaacacaatgttgactagaagatgaacatttactgtgtgattccatctatatgaagtttgagaactggccaaagttatctataatgattcaggtcagcagagcagtttcttcctgagaggctggtgggaatatagtgtgaattgggaaagagcatgaaggagacttacagggtgctgcaattgttcagaactctttttccttgatacttgcttacagaaatgtgcagaatttttatttcacctagttttctatgcatgcgtagaatctccatagaacacacattttattaagtacgcattcaacttcttctaaaatacctctagtcatagaaaatgtaactttatttctttattccttactttgcctagcccaagctcctacaaaaaaaaagattagttaccatttaattcaaattataaaacagaaccagtcttttaaacagtatcggatacacaagtatctaatctaacttccattgcctatcagtggatgtggctttaatcaagtcttttctaaacaagatggacaggcactgaagaaaaaaaaagtgagccattttatgtgttttaaaatgataatgtgattttgaattttgctattgtagaagctcctaacaatattatctggcatttgttctatctgaataaagccatggcttatattatgtatatatggaatttcccagaatactattgttagacacatcactgagctgtgaaaaaaaaaatcatctctaatttgatcaatatgtacttacacgtatatcattagttgccattgctctcagcctttagtacattttttatgagccccgtgggccatgagcttgctttttcataacagagaacgagaaagaagaaatctcatcagtataataatacccacatcagtagagggcatggttcagaggcaatcttgttgtctgtcacagactccatgatataagctagaaatgataaagagattcgttacaggatactgtaaaagggatattatggtatataaactcattaagtgttaactagatcaaagcaaatatggcagaaaagagtctctgaatactgtagcagagtttattgaatgaatgaacgaacgaatgaatgaatgaatttataaaaagcgcaggggggccggggcgcggtggctcacacctgtaatcccagcactttgggaggctgaggcagacggatcatctgaggtcaggagttagagaccagcctggcaaacatggtaaaaccccgtctctactaaaaatacaaaaaattagccgggcatggtggcgcatgcctgtagtcccagctacttgggaggctgaggcaggagaatcgcttgaaccctggagacagtggttgcagtgagccgagatcgtgccactacactccagcctgggcaaagagagcaaaactccgtctcgaaaagaaaagaaaaaagaaaagaaaaagaaaaaaaaaagagcgcaggggtcagataattgagttagaaggtagaggagtggggatgttaatgcccatgtgagaaaagaggaagaggtattgaaggaatccagcggactttgatgaggaccatgcgggactttctattttcaggaacctaagggaacatcttgctgtaggcagcctggggctgtctccatcaaagaaatgctaatatttacattcattggtttttgttatgtgactgtctatgtgctaaagctgtggttctcaaagtatgtttcagacccgcaatatcacctggaaatttgtaagaaatgtaaattctcgggctgtgcggagacctactagataatgaattctgggagaggtattataagaagttcttcaggggattttgatatagtctctaggttgagagacagtgtagtagacaatacattcattactttatttattcttctccatgattctataaaagagctattgttactgctttgtttacaaatgagaaaactgaggctttgaaagaggctcagtattttgttcaaggtcatatagctggtatccagagatactgggaatagaacccaaatttgtcagactataaaacacggtgctttcagccactcctccagagccagggggataaaaattcattaatttccatgagtatttgtaatagtagcccgcaagtcctggaatacaattataactgctacagcattacctttgaggagaaaatatctcatttccccaattgattgccaaaataaaatgcttaaaatacaaatgtctggttgaagaaaccctttaattttttttcttgcgttcaggcatttgtgtcaggtttaactaatttattttaacttgcaatacagtgttgcctgtagtaacaaataggacattctgctattagtttttaatctcctaccgacttgttattttccactcctgaagctaaacttctttaacaatttctatgctcattgtatctacttccttactcacgtagctacctcaaacaccaataatccggctgcttccacatccttcaactgaaattgattttgtcacggcccaagtcacatcaggcctcatcttaccactctgtagtattgattgttgatcggtccttcctattggaaaaactcttcttccctggcttctaagatattccactattctagttttcctgtctcagggcaactttatcattttcttggagggttgctctcctatcgtaaatctcttttaacgttgagcttcaatcttaatgctcaatcaacatatttttcttgatctcatcaaaatccatagcaataacaactcttaaccatgaccctcagatttttatatccaaccaaaatcattcttttgagctagagacctatccccctgcccatcagttatgctcatgtatgtcacatagttaattcaaaatcagtatatatgagatcaaaaactgccttctaagcaattcttcctccttctctagctcattgaaagacatcatgtgccaaacttctcaggtttgggggtatcattcttgcattctccctcgagatcactgttctaacattaccttggcatcagccatcatgttttgccaggattgttgcagttcccctaaaacagatgttcaatttcccccacccctgtgattcagttttccacatgcagccagaatgttttaaaaagcatattcgattgtgtcatcttccccctagaaaaccttctgcggtttcttcaaaataaatttaactgaataactagttgacttaattcaatgttttccttcgtcacactaattaatcagtattttcatggtcctcgatgctgagggcttaacattcaagaataaatttgtcttatgtttactttaacttataaacttcctttaaatgaaaactaattgttaaatgatttgcaaaataaccagaggcacaaagtctattgtgatcagtggatatgacagaatatattttttgttgttataccatcactttcacaaaactatggaatatatatataggcatataggtgtgtatgtatatatatgtatagatatgtgtatagagacataatttatagaaacattcgtaataaacccctgccaaacatattttgcacgtttgaaatattagttgattggatttgtggtttgtatgtaagttgaacaattaactgatgtgatcattctgtttccatggctgttaccttagtttataccaccttttcacctgagtgattacaatagcctcctgattccttgtctctttatttgccacgttcccttcttcaaacttcccaaatccactttcccaattgttatcaaaaagagttttcctaaaatgtaagtcagataatgctactcattatgccaaattctcattgccccaaaagtgaaatctgaattctataagatgctctaccaatctctccattaattggcctctgcactatctctttacattcaccccttcccacccaccgaacccacccatccctcaagaacgacattgtacgtactaatcatgtcatacaagtcactattctagcttctgttattcttctggaaatgtcatctcccacctcaactttttacccagctaactccagtttatcatttaggtgatgtctcctttttggaacatacctagaattgacgttacaggaggaatatctcttgtgtgtcatctcaacatcccacagtaactatttttttttctttttgttttctttctttcttttctttttttgagatggagtcttgctctgtcacccaggctggagtgcagtggtgtgatctcggctcactgcaacctccgcctcccgagttcaagcgattcttctgtctcagcctcccgagtagctgggactacaggtgcgtgccaccatgcccggctaatttttgtatttttttagtagagacggagtttcaccatattggccaggctggtctcgaactcctgacctcgtgatccgcccgcctcagcctcccaaagttatgggattacaggcatgagccaccgcgcccggcccacagtaactatgttttaacatacatcaaaccactttgcaatttcctgtttacatgtcattatccctcattagtaagcttctaaaaagtatgggcatttatccagttccctatcatctccctagtccccagcacaatgcctgacacttaagtaattacgtgagtaattaaatgagtaattatgacacattcaagcttgttaaactctaaaacttggaaataaggcaaaagaacaagtagatgttcttttattatcatactaaaaagtattgtctaaaagatctaccgacagatagtttaatttgttagggacatgcgtctttgtataacttagtactaacttaaaagataatttttttgtgggtacatagtaggtgcatataatttggaagcacatgagatattttgatacagacatacaatgcatagttatcacatcagaataaatggggcatctattaccttaagcatttatcctttgtgttacaaacaatccagttatactcttagttatttaaaaatgtacaagtaagttattattgactatagtcaccctatagtatttactattgattagggcttagattctgagaaattttacataaatgtacacatttttgttcagtagagagacaagtaatatctttctggcaccctcaaaatatataattttattgcactttttgatgttaatctgttttgtttctaacttagcaatcttgttctagcttctttttctttctgtgactatgtgtgttcagtcccttgaattcccctttgaatcagttttaatttgttgcctgttttgttattagttagttgaataaatgtttccatattatcaggatatgtttataagggaacagcaaatttacttccgtgtgttttaaactatatgagaaacactgagcttggcatcaatagctaattctaggggagaaaaaaagtcattctcgtatatatttggaaaaacagtttttattcctttttgagatattaacagccatttgtatgttgaagattctgagaaacttggaggtgatttaatctgttttgctttgtttaatctaaaatttcaagattattttggttctaggaaattttgctctagaaaaaacagtttggaaacattggtttacttatagctttaaagaacaatattttaaactacaattcttgtgttcgaaatgctgtaaaaatcatttctattaagatttatttcctctaagtgttttgcattcaaataaggtgaaattctgggtctccaaatatacatttcagaaaagtctttgtttagctgtagggaaggcatcctgacttctcatcattatagtcacatagatacactagatttaaaggatatttaggtcgggcgcggtgactcacacttgtaatcccagcactttgggaggccgaggcgggcagatcacctgaggtcaggagttcgagactggcctggccaacatggtaaaaccccgtctctactaaaaatacaaaaattagctgggcgtggtggcacttgcctgtagtcccaacttcttgggaggctgaggcaggagagttgcttgaacccaggaagcggaggttgcagtgagttgagatcgtgccactgaacttccagcctggggaacagagccggtctccgtctcaaaaaaaaaaaaaaaaaaatagagcgtaattatatattttccttattttaaaagggaaaaaatactttccttattttccatatagagtatatcaaaataattacaatcattaagtaaaactaacatttacctgtggtctaaaaaagtcggttgaggccaggcgcaggggctcactcctgtaatcccagcacttcgggagttagaggccagtggatcacttgaagacaggagtttgagaccagcctagccaacgtgatgaaaccccttctctactaaaaatacaacaattagccaggcgtggtggtgggtgcctctaatcccagctacttaggaggctgaggcagaagaatcgcttggacccaggaggaggaggttgcagtgagccgagattgaaacactgcactccagcctgggcgatagagggagattcagtctcaaaaaaaaaaaaaaaaagaaaagtcagttgagatagtgaagatccaaagatatctgctaaaaaagtgtgtgttatctagttttaaaaagaaatgatatgcaaataaaaacattagtgagcagttaaatatttaaagggtacgttacttacattatgggtgtaaagtgtaagtggatttctgaaaacatgagcaccatgtgaacttcagtatttaaacaagtttattgcttttggcttttggatttattgtttttttgaaaatgggtctgagaacggcctagaagaatgggtagacttgacatctaagtctatctcaattctgctcttgagaaaagaggaagaaattgctcagaatgttctatcataattttcttcttgctctttagatttctaaatggctacacaggtattgagaaacacatttttatcttgttatgaacactaaaattcattagccttatatttcctctttccttatagctgtgtcttgtttttgatggcttaacacttttccattctaatcaagctttgtcatgggctatgggctgaagtgccttgtgatggactgatttactttcagtccctgtaatctgtgcccttgaaggctagaggttgaaatcattaaggctctgctgttgcccttgatctctgctcaaagaggctagagattgattggttgacagtggttgacctggacgtctcaaaatgaagccgtgatgaaggaaaatcaagtacacacgttcagaatatttcataatgacatttattctgcgtgcattttttccagcggtatttttgcttctttttttaaaaaaaatctagtttaatcatttctagcccaccctcaccactaccacatgtttattccatttctacattctggggcacttaagaccttttaattccttgaattagtcatttataaatgttgtctgaatattctatcaaagcaaggcagcatagagaacttattattacacacttatcacatgaaaaaattatttattagcaaatatctattcagagcaaacattttgatcaaagttggcctcaattcactaattagttattatgcaaacataacaaacatccaatagaataaatattcactcttttctacagttttttttggaatggtttcagtgctggaaaaaaaaactaaaccaattcatgtaagaaaaagtaaatgtctgttaagagaaaagaccacttttaaatacacgttttaatatttctattttaatttctacttaaaaaggttaaggaggaatattctaaagacgaatatatttgcaaatactgtgggaacactttattgaaccaatttgagaactaagtcaattatattgaatttacatatttggttaaagaaaaaatgagaagtgattagattagttcaatatttaagtgaacttaacagaagtatccaagttcatgttgaccctattgcttcgtattaatattgataattacaaatatacatatatattaattttcaaaaatatagattatgagtgggtaataatagcttctaaaaattcactttggtactattccatagtggccaagtttccttttgttctctggagggaggtggcctaatttaggcaagtttagtatttagagcaaaaaaaaaggcagtctatgcagagattcaatggcatcttaaacctgccccacctatctctcattttttacattgctttttcattatcttttcctttcctttcgagagacttgaatttaatattgtctctcttttccccatgtttgccttttataaatctaagcatttctgccattaatactgtaggttaagaaagtggcagccaccatatttaaggaatagtaaaatctgtaactggggaaatatacagtcttctgagaaactgaaataaatttcaggtaaaaagtatgtgacgtcaattgagtggtgcacgtcgagggatacaaacctaaatacattccaggatgaaaatcgtgataagtttggagctccattttcagggaagtttctgtactgactttagaaacattgcaaccaaacaaatccttgggaactgtagaaaggactctttttagtgttcaggctaagtagacaatgcctacatatttaaagtttcatttggcagacttgacacagtaggcttcatggaacacaagttatgccttccttggtctgagagagagaagactagttctgctcaactgaagttaagatctgaggttcagtgagtccatatagatatcatggaagattgagtgaatacactggccctaaagcaacagaaagagcacaagttgagatacagttttaatccccaatgattggaatcaccactgccagatatcacatcctaattacacattctgcccttcaagctctggcaatacttttcttgcggtgccccctttctttagtttgccatatgaagagtgtggtaattactttccctgcagttgtttaccagttctcattcatttttcaagttttcctttctctctctctccttttttttttttttttttttttttagatggggagtctcgctctgtcagccaggctggagtgcagtagcatgatctcggctcactgcaacctccacctcccgggttcaagcgattctcctgccctcagcctcccgaatagctaggactacaggtgcatgccaccatgcccagctaatttttcttgtatttttagtagagacgggatttcaccatgttgggcacgctggtcttgaactcctgacctcaggtgatccacccgcctcggcctcccaaagtgctgggattacaagtgtgagccaccgctcccagtcgaatttttctttctctaaacaattttcagtgtaaaggtctgctgtgctataaatttgtgacacatgattgtgttgtagttacgactacgtaaggctctatggacaggtttcctttagttctgccagcacagctaaccagctaatataaatataaagaaatgcaactgttgacaccaaatgcagtttccgtttgcctgaacaatcaacaaataaacacaaaatctgaataaacattacaatgtgaatctatgtgtctgtatccataattatataaaattgaattattctaaagaattctatgtttcttaacaaaaatattatatgcatatatacagttaggtttaatagatttgtataagcatttctaattcttagcttccattgatcttcagtgtttcagaatatttatttcaaatcacttttggaagaaagtaagtttacaaattgtgaaaataatacacaaatcagagatccctatttaaaactaatccctacatcgcttcatcaaaatgcctaaaattcttttttggaatgaaattcacagagaattgcaagattcatttcctttacacttttattcactgccaataacttggggatactaagagtgcaggagaagcaggtaattctgagggcgttttggaggaaagcagttttgcattggctaagtttttaaaaaagattaaacatttaagtgccttgttttaaagatttgaatgataatgatttcaggtaattgatttttaagctatatggtaataataagacaaaaataattcatttgtttccttttggaaaatagattttttaaaagataaagatctgttttaatttttgtttttatttctaaggtactgtccaacctaaaaatatgaaagtaggtgtgcataagcttttttaaaaaaaaatcgccagtagtacaaacaaattttatagtccatcatttgcagggctggagggcttgccatatttaaatgtgtgacctgttttgagtatttgggtcaaagagaagggaggcaccagtgtttaaagtggcacaaacagagggaagaatgaaaatacaatcgaatatattcatttttattttcataaataaaagaaagtttaaaaaatctaggtacatcagtaatgttcccttagatagtattattatgtggctattgtttactctcctttgtcagcaacacgatcagtgattttcagcacctgctattgggttaataatggagttagagaagcatgagtttcaatttgtgctcatctactgcaaagtagctatatgaacttgggcagttacttaacctcgctaagctttgtttcctatccatacaatagggtcaagagaagtacctctcttacaaggtctgtgaaaatgaagtatgttcatgtgtttaaagtgtttagtaggtggcacatagtaagcactcaaattatatggactatggccattaccttgacaaactatattctctctccatttcctcatatgtaatgtggattaacacgaagattaaacttaaaaagtgcataaaaatctcagtgtctagcaatttgtagatgttcaacattattaaaattccctcctcaattttgcttactttgctgtactgaatgctatgtgagataggaaaggatatcaattatttgctatgccccttccgggcactaaataaatacatgtttttgttcattcttttactcaatctaaaagttattgagcaccaaataggcatcaggaagtatatggacaagtataggaaacaggattgatatttacaatcaggagaacaattttgagcccccagtcagtcacttgatgttatcctgggcaatcaatggatagagtccaaccactctaagcctcagttttcttatttctacatgttgatagtattaatagttgttataagatttgaaacctgttatggactatagtattttgtgcagacattagtcaaaatcataaattattttggggagcacatttacattcctcacagtgaagccttgggccctacacctttgcactaaattatacatctgtagcaggaaaaaaaaatttcagtatcacacaaatttaagtgggctaaaaatggtattttattaatttttctatagctaaattaaatttctattttggttcctcttttaatttaacaggtttcttaatataccattctcaggaaatcttaataaaattcagtgacttttcaggtctaccggtcacattcaggagttgttaggactctagcctccactctaggattggaataacacaggagtattacttagcttcatggcatcagggccaacttctgattctaggtcaaggacacacagagatgtgacatccaatgtggtctgtggggaagaagatctttgcatgcaggcattggctgaagtgaaccagtacctgcatcccgcccttagttgaactgcctattctgcctccaggatttggggtgtctgtgtcctgattaccacacccttgaaagactgccagcttgctcctcctaacttccatgaccttctcaagcaccgacacatgttagctgcttatcacaaacctgatgagatgctcagacccctgtgaggctaatctacatgcccagtccctttgctctggttgggcactatttttcagcagctccagaacctccttctcttctttaggactttggttccctaagaggacattataatgttcctcttatttgaaaaggtgtgtgtgtgtgtgtcagagggtcaggaccctccccacacccccacacggcttctagctctcacttatctgtaactctctcaacttccccctcttcttctcttggtaggcacctagagcaggtaaaaacttttaaacaggattcttctatatctgtttatgccagaatcatggttcacttacactaaaagcagttgacctctgtcagtgaaatcaagagttgattttgtaattcaagagctctgtatttataaacaaccctaaggcagtgaggaaacagtgcctaacttaccttacttgcaaaggatggaacttaagaatgtggttacaatctcacgaaatacttgtgtgtgtgtgtgtgtgtgtgtgtacgcacctgtgtgtgtgtagttctgaagatggcattgttaggtggtggaggcctataatattatgattctcaacatgtgaattgttatcacaggcaactaatcctattgcctcaggtttacaatctgtaaatgggaaataaaatgcctaatgtttgttctcagcctagttgtgaggattaaatgcaaaatacagcctcaacaaatgtgagttcccttcctcacattcccttgtaaaaaaaggactttccccaccccccttttatttagcatatcaacaattactcctttatttgggactgaacagccttttactaactatccttttgtttctcattttttatattcatgcatagtacaacttatgaaatattttaccccaaatcctcttgggtctgctttatatgcataaccaaataaggcatatttttatacaactattgtgttttatcttaaggtaaatttcaagctaaagtgaaaaatgaattccttctggtattcaggcagaattttccttacgagaagtaggtcaagaaacattgaacgcagaataaatttatctctgaatacggctcttcagctctggattgtttaaggatggcctagaatctacgctgagcattctcttgcatctcctttttcagtatggttctgaattagcactcgggcataaagcatttccttggaattgctcttatttttgtccccatattctgcactccatcgtcaggtaagaaggcaatatgtagcagtcatttaagaaaccagcacataaattatttccgaagttaaatcaatgtgcatcttactggttcagttcacagttaactagaactgctggggcttgcttttatgaattgtcccattccctccttgctttctttttgagactgactcttgctctgtcacccaggctggagtacagtggtgcgatctcagctcactgcaacctcctcctcccgggttcaagtgattctcctgcctaagcctccctagtagctgggattacaggcatgcaccaccacgcccggctaatttttgtatttttagtagagacggggtttcaccacgttggccaggctggtcttgaactcctgacctcaagtgatccacctgcctcggcttcccaaagtactgggattacaggcatgagccactgcgcctgggctctctcttttaaacaatcataaatatgaaattaaatgggctgactggaagcaaattggtctgtaggaacgcccatgaaagtgttccattctgattgttttcccatcctgcagcccctctggcctagtggaagctcctttcgttttgcagatttagattaactggggtaggtgagagagggcagggatggcaggccatttgtctctcatcaccgactgaaaagttgagcctaatatataccttttgctcctctacccaaatgaattacaaaattctaattccctcacacaccggggcctgttgtggggtggggggaggggggagggatagcattaggagatatacctaatgttaaatgacgagttaatgggtgcagcacaccaacatggcacatgtatacatatgtaataaacctgcacgttgtgcacatgtaccctaaaacctaaagtataataataaaaaaaagagttgattgtttttataatctaaaagtaaagacagtttggttttgtcaaaacttctttgttttctatttattttctctatagcttctaaatttgtgttctgcttgtgcatgcgtgtatgcttgcatgcatatgtgtgtgtgttttccttaaagagtaggcaaaaaagggcagaaaatagatcattcccttataaacctgacaagtacctgtttgtttctttcactgtggtaactggaaggctggaaatactgagcacttcagtagtcattctaaaaagattggttcatgtttaatttgtttgactgcccaaacctctaatggttcagtgaaaccttcgtgaggattttaagaaatagatcaggtgatagtttcagttgaagctactaaaaaaagcctttttgttcatattattttattagagtgggaaattgggaattctaaaatgttcccacatttgtcacccgtgttactctggcagccttttgtcatgttcacattttccctgttcgtttgttactgctgctgaatgtactttaatgattctaataggagctatagattgtgcagaagaataacaagcttcaaattaaaaaagaatatatttgcattttgtggcttctaaatattaatacaattgaattgtttttgttgaccactgtacattgacttcccagggtccggtgcatagcaaattcatagatgctccataaaataattatagaaccatgcattcgtgtgtgctgtgttgtggttctgggtactaaggatgtctgcctgagtcctgaatgagtcttaatctccatccaagttgtgtgtttcagagttgggatggtgcaaggaatttgattattaatgtaaactttagataactcatagcatgaataacaactgtacagtagaagaaaaatgcagaaagaataaaaaacacaaacaacagctaaaacaacaacacataaaaaacctcaaataattagagcaacaggctgtgaatgcatttagcaaacatatacccttcacttacttttgggaatccagtaactttctcctctgagttcaatgaaaaatcagtagcacttacgggtgtgatcattaactttgtttacttttttagctttcaatgacattcacgtttgtgttgagatttgttttttctttcctgaacattttatcccattcgccaatccagaaatgatagaataggaaaagaacaactagggctttatgcaagtacagtaaaatctattgatgcccctctacaaaaggctgcaaattggaatggctgaaatcatctgctcgtcttttgtgttgcattttaggactatcaatgaaacttgaaatgatatattaatagaaagtttgaacaggaattatatattgaaaatgtgacagaatgggtagatccaatcatcctaggctgttgagaagggaatatgcctcacagtcttgtactttttagatgaagccttccaatttacctggcagcccacctcatggctcagtgtttagtcatatagcagaggttgttacaattacaaaagttctcttttttttccatggaaaattgatcatttggagcagtagattaatttatttcaattttaaagtatgagaggcatagaggtacattaaaaagaacaaagactttgtagtcagagacatctaagagttgtgtaaacctgagcacataagtagcattttcttatctatatgatgggatggggttggggtaagaatatatatcatataggcagttacaaatataaaccacacatcacgtatggattttttttttagatgaactcatttatttgacatattaaattagacaaagaaatatatatgtaaccagataaaaacaatcacattctcatactacttgaacacaccgcagtggtcaaaaataatggattgtaaaatggaccccaggatttaatgcaaaaaccaccccatacgagaaaagtttcaggcttctaacttcactgaatccagtactaaacgtgcttctttatattcctcagcttcttccaagtctttttcactttctaatatctgttgaagatccaaatatgcggcttccaacctgcgctggcaatctgggatcatcatccgggattcttgtaggatctctgcctgctttttgatgtcataattttcaccatcttcagctctcattttttcaatcttttcttcttgttgttttgcctctttttcatacatcactttttatttgaccaaccgcttcaccacaccggtcttgatcttgatctgtctcacgcgaggatcggccatggtccctcgagccccgcgagaaggaggggcggaaagccggggtaaccgtggagggcgacgcgcagaggcggtagctatttaggcttggtcgccggcgcgcatgcgcaggctgcgcggccacttaaggagtttttataataaatcattatagtgtcataccttccatcaaaggattgagtactcaggtgtgaacattggtaaacaatttttccaatattaacatctgtagtattttaaattatgtgtcattttaaggtactgttattctctttgtaatttaacattttttataatagaaataattttgcaattgctacattaacattttgagttgattattgcttattgttagcaattccattgcatcattttacagattccatcactgtgctgaaacatcccatctgtttgtgaaagttttggatgttttctttagtatctagatgaatctattccttatcttatcagtcagagatattttaaagtccttgtctgttagttcaagcatataggttatctcttagtctggttatgttgatggctttacttcttgataatgggtgtattttgcttagttttatttattttttgcaagtctcattttctttttagtgaatgttagatgtcatgtatagaagaaaaatagagaatgaggtaaatatgtttaatcttggaaataggtatagctttttttctgtcatactgctagtatggggtttgagtcagtggtgttagtattgagctggtttggaggggcgggggttgttgttgctgtagcaaccttcagaacactacagtcttcaaagacctccactgatgggctgctgctatcccgtgcttaatgtaatagtgtctgcggtcctaaagggatttctatcttcttgttccatcctcagttttcagcaagccttatatgcctgtctctcccctagtggtaacagatcattctgtttttattggtgcagaatcctgggccaaagaggttatcatactgctcttccaaagagggtatcttgaccctctctcagtggcttctaccttccccaacccctctgaacaggcgggtcccatgggtggtagagtttagtatctttccttcagtttagtatctttccttaaatcttacgccttttagaagaggagggtctggaaaatgggtttgacttcatgtttgtgtgtcactgaggggagcttcttcctatctcttgtcctacgccttacttttttgcaagttcccaatagaagtttgtggaaaagaattccagaatgagtgcagactccttcggtctgcatttccaaggatgctgaaatgtcataccagcccacacctgacttttaagaatgccttacaattggagctattttctttttcctgctcctacgatgactacttcttcctccagttccctgccaaaggtaaacctttcatgtatccagtctctccttggaggagattgaagtactttggctcacctcgttgccttgtggccacagctatataaatggctcaaaaaataatacgtttttatagatcaccctgctttttctcattgggtggagcaacgttcttatatagcatttttacatcctaagcagaagaggaacttgattatgatggaaagcgtaagtattttaccctcttgggatatccacattcgacatgttaatcattacagttacccttactttagatggaaacaatgaataatacttatttttattagagaaaggccgtagtagataagtgatattttaaaaattgaatttaataaaaatgtattgaggacctgttatctgtgaatcacccaatgggaaaagtcatgaaaagctgaagaaaacacttcattgtatttcagagcttttaatttaaaggtgaagaaaaaaggtgactcaaaagcattttgtatattcagaatccatttgtgaaacctaatttgtgatgttgaaactgagatttggcacactgtccaaaattgcattcaaaagtgtagaacctgctgtcctggcctttttgttttgtttgtttgtttggtggggtggggtggggtgggcgtaggaaggaaaaagaaaagataaggagtgtggtattgactgatagtttattctcaagtgcagtcaccagggagttcgaactgacttctacttttgaagttgaaacatggaagcagggctccaaaattttgtatctcattgaagtaacttagaatactcacacttttatgaatgattgagatacttcctaaaaatttaaaccatgatatctccaacaacggaaaagagggaatatgaaacccccataggctacgggtgtcaatcaaaatagtcttcggagaaatgaaatgttttcttcatttactataaaattgaagaaaaaatttcatttttcttttttttcttttttgagacgaagcctcgctctgtcacccaggctggagtgcagtgacgcgatcttggctcactgcaacttctgcctcctgggttcatgcgattctcctgcctgagacttgcgagtagctgggattacaggtgcatgccaccatgcccggctaatttttgtgttttttagtagagacggggtttcgccatgttggccaagctggtctcgaactcctgacctcaagtgattcacccacctcagctcctagagtgctgggattacagatgtgagtcaccgtgcccagccaaaaggttcatttctcaagttttacaaaacttttcagtcaaaattcacatatctactgtcacataattcatactcaattacattccttcaaaaatgctctcacacaaagtttgaacacatcgaggcaggtggtttgaaacatccatcccaaagttgagctgggagtcaaggtgacaagaatggcccatgagcagtgagatgtctaccaatgccgggctccggggcaaacaactaacattaagtgcaaaggattaaacttgttaattaggagaaaataaaagcaggcatttgcttattttattattgagtttatattaatagtaatcacttccattcatattagatgcaaaggaacttttaatattctatgcactgacttaaacttatttcttaatccctttcatctccttataatgatgcatatgagattattggaggtttggaggtatgcactaatgcaaagtgatgagctgtaaccaaaaagtaaccaagaaaataaaatcacaatttcatgcatgtatttatatttgtcttctatggcaaaccatggggatattgaaatatgaaatttcaaataccctctttattatgttagatgcattatttttaacaatagaagccttaaataaaatattaagatacatttgtattttgacacttaactgcccttggcattgtgcatttaaacttttggtgtctagcaaagttaaagggagactgtctttaaatacatatatattgatagtgccattttgttagacatgtcatctttcgaatgtaatgatattgttcacacattgattttattgatgatgttaaatcaaaatggtttctgcaattagtaacttctataaaacaaacatattaaaaggaaatcatacttcctattgtagtataccaatttatttttccatttaggaatagctatgctccctctcatgttttgttttgtataccttactaaattaaatattcattttattctttaccagtttccatcacagacacaatcagtattatttaaatttcagcaagaaactaaacaagacttacaagtttttcagtgctaatgatttttttttctcattaagtctgagtctaatgaaactaaacagaaagttctggttggattccttggtcacccctatctgtgtttgtgaattcctataattggcatgaattgaaagttcttgttatcactgatagtaacccagagacaattccaatttgggtttaaatggccctatgcagacaagggtaactgaacaaaccaaaacagcttcatgtgtttatggcagataaataccaattaagtactagaaatgacatcagggttttttttttttcctgtatagtttcaagttaagagactttttctcccttgagtttgcagatatagagcatcatgaccttacaagaggaaggagagcaacttcccatctgaatgagagatggaaaaattatatgaaatagaactaattctactgttaagcagtaaactacttattacttgagtattaattaggacacttggctacaaataacttataccaaatttgaactatctttatcaaatgtggaatttattccaaaggatacgtttattctaaggattaaaatgtttctcaaggcaggttagggcaaattgcagtacacctcagaaaatgcaatcaaaaccttccaggactctctgtcacatctccttctctctaaactatcttttttattgcagattggcttccgctgttcctcatgtagcagaccatgattgccaacattcccttatatttatatctcgcagttgaaggattcagggagagcctgattctaagacccaagtctaaattctttaaatacatacgtatgtatgtgtatatgtatatgtatgtatatatatatatacacacacatgcattcatgtttagatagacatacacagacatatatgtgaattacattgaattacatatgaattacatttctatttaatgtattcaatgtaggttacaatgcaacgttatagaccttttcatccattacaggtaggaatgtggtttaatatggaatttttgagaagtaatttgaaaatatgtaccaaaacttacggagatgatttttcacctaaatccattataatttttgagactcttttctaaggtaataatcccacatttgggtggaggctttatctatattgatagtaattgcaagactattttaatagcaaaaattatgagaccatttttcaaggttccaaaaaaaagcagaacggtaatttttatgggaacaaagaagacaatgcttctagatatttaaattgtgtttgaacaacattggaaaacctgttattttaaatgaagaaagtaaggtgtctaactacttgtgcaatgcaattacaattatgcaaggaaaatgcaaaggaaatatatcaaactttaaatcctaaagcttttaatactcactttttctctagtttctaaaatttggctaataaacataaatttaatttataaattaattgaccttggcattgtataaacatcagggtaaataatgcatctgtctctctgtctctctctcgctctctttattcaactttatcctaaagcatcatactaattacaatctattggttttagtttgactcctcagctaggttactcaaacaatgaaagactacttttaatctctgaagatgtttctttatcttgaattttgatttcctaatcaatgaatacttgtctaaatttagtattaagttcacacacatcttttctcttttttggattactttgccaatcaataatgttcctcttttagcggttactggttatttctactgatctctgctgagagtttattctcagacactttcataccacgctttgaaaatactggtttccaagctgtgaattcactgtatctatgcagaaaggagtgatttgtttcttgtatggcatgatgttttttatatcctgtgaaaaccatcaattccacatttgagtggttccttcatgacatgggctgctctaactaaagaaaaatgtgcattaaaaatatgtgtccgattaaggcattaaaatatcttaagcagtcaggtagcaaacaaatctttctgagttccaattactgtattacattatgtcaatacttactgtcaaagtacattacagaaaaaggctgggctcttttcagaaagggcattgcaatataatgggtgacaagaaactgcatctgtgtatatggaagcacaagaaactaacaacaacaaaaaaatagtgcccaatcctaggtggctgaagagtaatatctaagagaatatgaagaaaacccattatttattccctaggccagataaggagccctggctttctctggcatagctgcagtgtatataattatacctctttcagtgccaattactgtgtgtatatccataaaaagaatggtacaatggtgacagagatgaagagcagatctcttaaataaacatgtaaaaaaaagcaaagtaaagaaaaataataaaaacaggtctattgctgttaatgccactgttccagaaaaaagtaaaacagagatcattaatatccataagagccagaataatgtctatatttttcatccaacatttttcaaaccatggagcccttttagaatctgctgatgactgtggactctcatatatacacactcataaaattttgcccacaattttaggggtttattccatagtcgtattgaaagcccatagatttcaggataggaataacaatgttgattactcatttggggccagacactttctatgccatataaagataatggcttatttagtcctcacaacgacactatgagatagttattattttagtacctattttacagatgagaaaactaaaggaaagaaaagttatgtaaataaattgagaaaactcagccagtaagcggcaaaactggactttaaatccaggccgtatgattccagagcatactccaacaaggactgtaaactgcatcctgcagaaacaaataaacaaacaaaaacctagaataaagaagcagatgatagagttttagaactggcggaacacatagaaattatcttttccaaattctatgttttaaagttgaggaaattgtattccacataattaaatgattaacagaagcccatagagcaagttagtgttagagccagggttcaagtgggaacattcatccaaagctcatgacaaagctacaccgatattattatcattattctacaggtgaggaaacagaggcacactgttaataagtagcagaactacctttcgaacccagataggcaggttcaaagctaaaactaccatattactgtaattcaggaaagccattccctttataattcgtttagtaggcgctcggaatgatcaaatctttaaattagaaaattcgaatgtcttcaatttacaaactttggaaattctggagattctactttacaatcattttaatgttctctaatcaaaaactaatgttttcagtgtgctacaattcatgaattttatattcatatcagaatataaaattatacacatgcatatatgaactttatatgttatatatgtatgaagcttatgtatgtatataacaatatgtatatgaacacaacctgaatacatatgtatatatagataaccattcaaacattttaaattggctatagaggaaagcaatttgccatttgacttaaagtcttttgtaatgactagaatttaaaataaagtttacaatttatgaagatgaaataaaactatacttaaaatgctgtttttcgaaacagaaaattcccttaaaacctcaaaatctattgtttgttttatataataaaaatccaaattttttctacaatgtctaaatcttttgtaattctgttatattttcctctacaagttcaactcagtgatacctaagtgcaaacaataaggctagtatgagagctttttttttttgagacggagtctcgctctgtcgcccaggctggagtgcagtggcgcgatctcggctcactgcaagctccgcctcccgggttcagccattctcctgtctcagcctcccaagtagctgagactacaggtgcccgccaccacgcccggctagtttttttttttttttgtatttttagtagagacggggtttcaccgtgtttgccaggagggtctcgatctcctgaccttgtgatccgcccacctcggcctcccaaagtgccgggattacaggcgtgagccaccgcgcctggccaaaagttacttaatttgcatgccaacctacactcacatctattaaatgattagtcaatcaagatatagacaaaactcatctattggcaatgtacactgagggacgtgttctcggtgtagtcctgtcaccgatcttagtacagaaataaataccttttttaatccagtggcataataaacctgagaaaagagaagtctttcattaagaatcttggaagaagcagtcgttaaccacttgtcatcagtattagcaactcaagctgaataaaaattgattgtgtgactctggaccttctttgctctgccacttggataatctattagcattggcacctgattaactctcaaaactgtctcctcttttgattagctcccaggatttcttttgtattctcagtaataattttccaaacccttttctaaaagactgactctaatgttcttttactgactgcaaagtttcccgtcagtgctgaaaacatgtttggccttcattcctatttataatttttggcttgatctttcataaacactggcttaagacttccgtatttggtgaacagggagtgaatgattactccgaaactttatttctgttttaagtgctttcagtatttggcacaaggtggaaatgagcaggctcagtactgaccattgctattacaataactcactgcatttccttaaaacttattttccacttaaattgttttctacattgatttctgtctgtgctaatacttggccatgtatgagaacaacctgcttgttttaatgtttaaattttgaatggtatggtaaggagaaagaccaagatttaaaagataatatattctgaaagggcaatttttggaaagcttttaatacttcatttaaaacccattcttcagcttattttaaatttaatgatggaatacaaccctctcttttttaaatgaagaggttatatacattccatcattattgaattttattctatgggccacatttactatttacctgctatattagtcagctttattataggctaatgctctgtaaaaaacaaatccaaatctcaatgacttataagaacaaacatttatttcttattcacatgtcaggttcaattttgtattgagtacaggtcagctctatgcatctctccttttaggaacagaggctacctgaggcgtgtacttcccctgacaaagggaggaaggaccaagaaaagtgaaaacactttatgattcttaagcccctagctcagaattgacacactctcatatctgactgtgttccactggtcaaggcaagtcacatgaccaaggccacatcagtgagtgggatgtgtaatccacccatggtgaaccatggcaagtggaaaggaggaagaaaaagaaaccgatgagcaaataatgtaaactaccaacttgttcaagaagttctaatgcaattaaatatatagtcaggaataataatactgatctctattggcacttactttgtactaagtctttgcttaagactactttcgatgctttacaggatacctcatcaaagtgaagctaagagtttttttaccacgattatttcctcttttcagactggaaatcttgggtttggtgtggcttatgagtcttttctttctttgttttgtttgtttgtttgtttgtttttgagatggagtcttgaactcctgtcggggctggagtgcagtggcatgatcttggctcactgcaacctcagcctcccaggttcaagtgattctcctgcgtcagcctcccaagtagctgggatttcaggtgtccgccaccacgcccggctaatctttttatttttagtagagacggggcttcactgcgttgatcaggctggtctcgaactcctgacctcatgctgcgtccacctgggcctcccaaagtgctgggattacagacatgagagactgcacccggcctatgagtcttttctaacactgcataactagtgcatgatcaagccaagaaatgtgggcccaaattccactacagagagcagacaataacgatgctcctatgggccattctggattacatatcccatgcaacaattgaggagccctacagggcatgcttagcaattgttccattgtttttttttttttttgtcctttttaatacatagacttctgtccctcgtttattgagggttgcccctgggagaactaaatctctatcacttctggactgccctgcaaatgggcttaccaagccctcctaaactgaagaaagccttaacacaaagaaacagagagatgtggatgcttgtggtgaggaatcttcagcatccacagaatccgttcactatagttataggtgaactcagggatggctcggtgaaataagggatgaggcattatcctcatctactatgccattttattaacctttactccatagtgtaagttgagtaaatacatcttgtgatttaaatatccccttataatccaggccctgtgtttgaccatttgtctgtttctaaagcatctcattaacagtatgtttggaaatggctgttgtgtgtcgtgcacatttggctgtttgctttccttttggtttgcaaagaagtattttgcaacccataaaaatagataaatatacaccacagaacaatgtatttttttaaattttcaggggagaatttgaatcttttaaaagtaatattgagtaggcagctgtatggaaacaggcatctagttagcagttctgctacaatatccaagtagttaatttcacctctaaattacactggagaccttgaccttattttgatttattctgtcataattagtctatggttattactttaacaaaaataagtcatctttctcatgaacactaccaaagcacatttcaagtctgcatactaattaatagtaacttatttttactcctaacaagtctacacccacatactcatgtttaaacaagatgagatatttgaaatcactttataaattataatgcaccacagaaatatccattatttccattattactaaaaacttacttcattcttttgagcatgaggaggtataatttatgtgaatatcatttcatattttgtttttatctttcaaatcgagaagacttgaattttttgcatatttacaaatactataaaaatcctactaattattaacatggctgccacgtagcaatcgtgtctattttatgaaataatgtcatttatacagaagacccacgggaagttgtaatatatttggaagtaaagatttataggttttgtctatttttttctctttctcagcattaatatgtcatacatgtgtcacatttagtcttcacaattcagtatctttattactattaccatgaaacaaatagaggcaatgagacacagagaggttaagtaacttactcaaggccacagagataatgagatgtgaaactggagttggaactcaggttatttgactctgaaatgagtgtatgatgtaaccccggcctgcattgtatctaacacatgcaattttaagaggataagaattaactgtttgcacaatctaccagatggcactgtttttccaactgagaccacttaacaccttttcatatactcttggagttctgatcattcttccactctaatacatttcttcaatctcattgtcattatgtcctacttcatgcaacttcgattaattcttcacaagtatatttctacaatacttgtgctatgtttccaatgtatagagcattgcaatttttatgaatatacaactatgcgattatgttaggttctcaccataactccaatttgctaatggagcataaattctgtgattaagtggcagggaatgggagagaacttttattcaatatgagctgacatggctttccaatctggtttctgagtccaacaactccctacaataaaaaagcaattgacctacctgagaaagaagtggcgtttgcagtggaggcaaaggaacagacaggtcatccatagcattttacattgtgtcagaagcatgacagtcatgaaagatgaagtaaagggcaattatatcatattacagagtgaaattcacctagagaaataaaggcagattgtttgcaagaaatattctttctcttaattttttattcattgtagtgatgaaaataagtagcaatatttcagttccaaggctaaattttggggagaagtcattgaaagttagttttatgtctaatgggtgctcaatggataatttaggaaatgaattggtgacagaaggtctataattaacagagtagtttgagcagtatgatgaagtgcagggggaaagcattggtctaggacttagtagatctgagatttaattacagtattgattagtcacttgatttattcaacaaacccttactaagtacctatttctgcttcagtataccatgtttggtgccaggagttgcaaagacataataattctcccatctaagtgtggtcacatttaggaggtaatgagtgggatttgggctgcattattggaagacaacaaactaattttctgtttgtgtgtgtgtatgtgtgtatgtgtgagtgtaagcaagatgagatatttgaaatcactttataaattataatgcacacacaattaaagtatctgtgtgtccatacacatacagttaaagtatttatgtgtgtaacacatatgcataattagaaaaaagcctacacatatgtatatatcagaaggattgattgataagttatgccagggagataagtgtgattgtgaaaaccctcacattcgacctagatcttaatagtgagtgtcctcattctagggagtgcatgaacaaaggactaaagcaagaaagcatatgatttatttatggagaaatttggcttgtgtgactaaggcagacctggtagatgtatataaggtttgggatatgggtgactgccaacaggcctaatcgataatatgtttagaggagtacactggagtcaaattgtgaaggcccttatatgccattctgaataatctagcctgtaacctcatcagagaagctctggatttttcaagttagttctcttaatatatgattgtaacagaactgtagtttctccatcagggaatttagctttatcattgattatccatgatccaactcccctaactccacatataattaataattagtacttaccaatactaccccgtaaacacatcttgaatgcacctactccttttccagccccactgccattcattaatgcaagtcatgcttacttctcacgtggattataggtataatcagctcatgtgtcttcttatttacagtttatccccaaatattctctacactgtgaaatttatttctaaaagccaagcctgacattgctatttccctacttaaaattctgctttgatttcgaactgccctctggctatattttcaggctcttcataaataggttgatgataatttcactttttctagggtcatctctgccatttttatcctcctccaccatctctaggtctgggaaaggaccatactctttctctcacatcctgacactttcacctgctcttttgattttctggagttctcttttctaccacttgtctctctgctcttaattaactttcaaaactcagctgagatgtcacttcatcaaggaagctctggatttttcaaggtagtttccttaatatatgattgtcacatgactgtagtttcttcatcaggcaacttatctgtatatttgtatcaacatacccttttgttgtgtctgcttctctcactaagctagaaggaaaaaagctagagacactgcctttctcacagttgtttttctaccacctagtaggtgtcagtacacatttgtcacttaatagccttaaatatgaaatgtaatttattagtttcctattgctgctataaaattaccacaaatttagtggcttaaaattatatacatttattctcagacagttctgcaggtcagaaatccaaactggaacttactggactcaaatcatgatgccagaagggctgtgtacttttggatgctccaggggagaatctgtctccttgccttttccattttctagagaattcccacgttatttggctcacggccttcttcgtacatcttcaaaaccagccacctcggaccaagtccttctcatagtgctttctaattctccccttatgccaacatttccccccttttaaggacccctgtgattaaatcctgcccactcagataatctgggataatctccctatcaaaagttagctaattagaaagtctaattctatctgcaataattccactttgccatgtaacataatttattcacagatgtcagggattagcacgtggccatttttgaggaggcattattctgcctaccagagtttaatagaattaatatctgcagaggagaaaaatgagaagaggactaaaaagtaaatctggtcttcgttaacttaaaacacctttattgagcactactatgtaacacattctatgctaagtgctgggattacagctctgatccagacagtcactctcttggaaatgagaaaggatgtaggtgatgttattaagaacaacttttgtaggatgatgagcagtgaagactgcattacattgactgtaaagcgaatgggaaataaagaaatatctttgacatgaacagcttttctgttcttcgtgcagaagtttaattattttagacctcctcattgtaagctgaccactaacgtcacctcaggcggtagaaaaatcccataatcaaagactattactcagatttaatagaaagcatttttcataccattttccattgcagcctcctccactctgcactgccattttgtaatattaatggcacagtaaatccactttctaaatatgtcctaaatttgtttccttcctttataatgctccaaaatatcacataaccttatctaatgtttatcattaatcttccatatttttcatttttttctcatgtttgatggaagcagagaatagactgaacttaattgctctcccatattacttcatagttctttattttcttttctttcttttttttttttttttttttttttttttttttttgagacggagtctcctctgtcccccaggccggagcgcagtggcacgatcttggctcactgcaagttgcgcctcccaggttcacgccccagtagctgggactacaggcgcccgccaccacgcccggctaattttttgtatttttagtagagacggggtttcaccgtgttagccaggatggtcttgatctcctgacctcatgatccgcccacctcggcctcccaaagtgctgggattacaggcgtgagccactgcgcccggcttcatagttctttctttaagtgaaattaactcatcccattgcatttcttcactacgtgagtttctaaactggtatcaactttaatattcccttccccttttaaagatacattttctgtgtcacattagggatgaagatcttcaattaacatattaactagcccccaaggaaatatcatttaaaaaatgtttttctaggccgaatgtggtggctcatgcctgtagtcctagcactttgggaggctgagacagaaggattgatggagtccaggagtttgagaccagcctgggcaacatggggagaccccatctttacaaaagaaaaaaaattaaaaattagacagatgtggtgatgtgtgcctagagtcctagctactgaggaggcagaggtgagagaattgcttgagcccaggggtctgaagttacagtgagctgtgatggttccaatgcactccagcctggggaacagagcgagaccttgtgtcaaaaaaattttattttcttgtacagattatggttaattgctttgtgtaatgggaataattgttagtgtttatagaactgtttttctgtttttttttttcccccagtttttaaatgctttcacttacattgtttatctgatggcagagaagaggtcttaaggaggctctccagcatctcgctcctaactctcattgcaatttcattccatgccactccctttctcacattttagagtgcaacaaaacagaattgcataatgaatgagcgtgtactttcagtttcttatcactctgtccttgtccttactgtctgctcagtgagattcatctttatcctcctcctacctttattccttctttactttctctcatccttctgaactcaacctacccattaccttctccaaaatatcttttctaacacccatgtggctacatattcctttctccatgctcctataatacgctttaaatttatatatatttttgtttatgcaaaatgtttcatatttatctatgatgtgtctattatctactaggctaagagctctcccagactgaatcttgtttatattttcagtaactagtgcaatgtccaggtcatagtaagcattctgtaaatatttattttataaattattacacgagtaaatgatctcattatatcctgtcaatagctccatgagttaaagagcaattaatattctcatttcacagttaaagacgctaaggcttggcaattttaaggccacaattctaataagtcctgcaaagccactggaagccagttccacagatttaatgttccctcagtttgcccagtatcattcttctgcagtaacttgctcttgtgaatcaagaatattgcaatttaatatatcccacatttatattcctgagggactaaggaatataaaagttaataacagggtaaaagttcattgtactaatcttaaaaaatatgaaaggccacatatactgaataaaaataactttattagaaggggttaaagattactgagaggaaatacaatttttatgtcatgttagaaagctaattttatatgggatttccccgtagagagaataaaataaaacgttggtcagtttttgcaatttatgaagtagtggttcttcacttcttgacatctccagggaacagttttcaagtaaattttcctaagagagattttcttctttgcctctcttattaatatgcacatgcatgtttttattagtaaaataaaatcagttataaacaaaccctaaaggaaatgaaatagaatatgtgctgcttgaaatgactaaacaggagcatataatcattttgtaataaaacagctatcactttattcttttctcatttgctttgttgctgattgcacattaatatgttttactatagactatgtgactacagaaatagacatcatgttaacgtatcaaaatagtttctagaacaatttatatatgtgtgatgtgtatgtatggtggctttaggttaactaagggtatacagcttaaaatagtcaacttttaagcaatatgacaaatagcaataaaaatatatcaattcaagtaaatacgtataaaattttagcatactaaaataaaaattaaaaggcatatgaccacttgggaaaatatgtccattcactgactaaaagtgagtagcttaattttgatcgttaacttggattttatggttataggagttttctgcaaggaggtcagtgaactctatgaaactatatgcaaatatgtatgtgtagacatttttctatagagaaggttcattattttcatcagataatcaaatggagcccatgacttgaaatgtttaagaattaccaatatataattatctcattccaattaattttaaaatattaaatgctcaatagataaatgagccaggatgtaaacaagtattttgacaaaaataggaacatacagaataaataaatgcatgaaacatcttctacttcattagtaatcaaattaattatgattaaagcaaacatcaaggatctccttacatctaaacaaagcagcaataccgtaaaagactaaagcaacgaaactcctatgaatgacatacctgcggctgagatgataattcccaacctcattctttctgctaccagtagaagtgggtgtgatcacttggaaagtattataaagatatttagcaaaagtcataaaggttttcataatgttgaactgataattttttcgaagacaattataaaaacaaaaaagaagtgagtgcatgagcatgtttattgtgatttagtctctaatagcaaacaaaaggaaagagcagcttatatgagatttatgataaaataagtgaaaaagaaagaatattattttggttataagaaatatgtatttatggggaatttaaaagtgtggacacaaaaattttgattgatttttggatgttaaaatgtttccataatgatatataagacgaaaattgaaataccaaatatcaattagtaaatgtaaaagcattattatttgaagtattaacaaccatatcatccagcaccattaaagaaggctcattattcagttctagatcagttcatacagacaaataagttatgcattgccaaattccaggacgctattcacataggttacaacatacatggaacctccttgagttgttcaaaatagaagctctgatttcatggttgttttgcatttgcgttaatatgttcaccttttgtgactctgattatcttatggtattctgtattgttaattatgcaattataatgtaaatgatagatatctggtcaatgtgaaaagccatggactttgattcagaaaatctgtatcaagttcatttctgtcacttaatagctttattccttctcagcttgtgtttatgtataaagtagtaaattacatacagattgagaagacataattaaaacaaacttatgaatagtaaggcactaagaattgttatgtattttataataataatacaattaattgtattaataattattatgttgaagaaaatatatgctactataccaaaataagacaataattcattgaagacatttttcttgtattaaagacgtagaggtgagagaggacaactagcaaagatgtttatatgttgaagctcacatttagtgttatttacacagtaaataagtaacactttgcacataatgtcaaggttttcgtgctgccttcgatgcttacctaaaaattactccttgtccatataattgaaaagaataaaaattttattctactacgtatttttcacttaaaagcctctagattaaatcacttcaaaagacctcatattgagcttttggcagagggttttgggtatgtttcaaagacatctgaatgtatgctttcaactgactcatttactctctgctttctgacagaaagtacgcatgcacatgtaggaaatataagtggaattgcaaataaggtcatttacttttaggaatatatgtatatactactgataaatgatgcgttgaccaatcttcctccataaagtctatgaagatggtttaattttgaccatttgaaatgttccatttctttttaaaattattttggaagggctagtattaattttatgaaagtaaagatttgaaggaggctagaataggtttgaaaactattactatctgtttttatttattcacccttgtcaacaaaggaaatacttccatattgtagctaagatttatcatataccatatgaataatgttgatattgaacatacatatagaagcttgtgtgaataacataattaaataagaaaaatgtattttgtaatgctaaataaaatttctcacctaagatgacagtttgaaatttatttattcactgttatttctcatattgactaaaggaatctacttatagattagtattgtgatttaaagataaacagatatttttggtgcatgcatatatttgttatgcgaaagtgattccttatgtttttaagagaagcaacggagatttactactgaaaaatatatgagagcaaatatgattactttgtaaagggcattttaataacggttcttttaatccaagtagataaaatataaaatttatcaattttaaatatctctcagatgcattcatttactgaacattaactaatatgattatatttacaataattaaaaaaatagtcttttgcttggagaaaaacattttaatatatcaagattgatgatttttctgtccatttgacttaatactaatttccagtttaggggcaaaaagatcatttgtagaagcatgaattcagtgaagctgttttttaataatttttctccctaatcccttagtataaatctttggggacttttttctttgagtatttatatgtaaggcatgaagagtatcatttgcatttttatttgaaatgttctgacttttagatgaaaagaggtcctagaaattttagagttgtagaatctccccttccttaaagcatgcacgtatttgtcagatgtattttctgagctcttaatttgttcagacagtgtgctaagttctgggaagcaaagataactaaaccatgctcctgctcatcaggaaacctcttccatagtgagatcaggcccatgttagagtatgtagatgctgcaaaggaaggaataatcatttctccatggttgggtggatggcatggggaaaggctccgaaatagtttttcggagtaaatgacagctgagagtttcttttaattatactggagtatctattcataactggcgaataaatactgttattcagaggagactatttttttataatcatacagtatttgaacgactatgggtttggtcatattaattgtttttcagatattacaaatctgaggcgggatcttgctctgtcgcccacgctggagtgcagtgccatgatctcggctcactgcaacctccacctcctggattcaaatgattctcctgcctcagcctcccaagtagctgggattacaggtgcatgccaccatgcctggctaatttttgtattttcagtagagatggggtttcgccatgttggcctggctggtctcaaactactggcctcaagtgatccgtcctcactggcctcccaaactgttgggatcacaggcgtgagccaccgcgcctggccatttttcagaagtaattttaatttggatgccccaaaccagcatcactcatgtttaattccatttatcaatgaatgtaatactaaatgtaaaaaaacactaacacatcataatggaaagttactttggttgtaaaatatgaattatatttaaagttgcttcctaacttttatttttttattttgcattttagatgaaagagaagatgttcaaaagaaaacattcacaaaatgggtaaatgcacaattttctaaggtaagaatggtttgttactttacttttaagatctaagttgtgaaattttcaaaatggactatgtacctgtgtatcttaaaaatccgttttatttctctcatagtgtcattttattttagctgtgcaaatctggaaatattatgttcactcttatttaaggagtaagcagcagaagatatggcaaagatacactatttaattatataaaatgtatatctttgattcttcttgacaatgtgagtttctttaatgacatgagtcctcagagtttatagctgcaatcttccatcaagtagctagaatatgtcacccagcagaagaagatatgagggaattttgttgtgaaaattatcatttttttgtccctcttggtctttaccaagttcaagaaaagcaatataattgctttgggtgtattcagccactatagtttagagcatatttcaaatgattaaagacaataagttcatcttgtttttgtgcaggcttcaatccatactcttaatatttacttaatttgcaaatacaactcaatttttaatcaatagcgtgactctagatgattataggtggacacagagcaagatattcttaccttgaaaactagtattaggaatgcaatatatggaggtttattgggatgtcaaagtttaaaagacttgcattttaattattattctcgatttgggtaaatcaatcaaatgtttggtgagtcggttttcttatgtttccatcatgaatgtttgtatatgtatatattgattgcttaattgagacatcaaatctagataatggaaaaataaagctaataaaatatggcccttaaacccaaggctttaagagtggcatagttttgatagtggatattttgtttcttattgtaatgatttaaagagtcactaaaagtgaaaatttctactaaaatgcctgaaactcttaatagctatgaattactccctctatgggtctgattttgtaaaattcatgataatggagccaaaacaatccactaggagatccaatctcaaaagttctcccttttctatgacaaacatttttagaatatcgtctattctttgtggtatttggtagtagaatgttgccatgtactctttaatttaacttactgaattttaactaataaaagttcattttatttacttgctgaataattaacaaatttctattacagacgtaaacagaaacatgtattttaaaaacgttttttaaatcctcaactttttttagctaagtgaaataaaatataacaacacaaatatagaagaataaataaaaagtaaacctaggatatttaggaaagttattcataattctccgaatatttataagatggttatatatagtttaattgctgtatatactggcatcattgacatttttaagttttggaattctgaagcagacaagagacatattttcaaacaaacatacagacaaatcagaattgtgaagaaattttctgaaatagtaaatgtaacaatactctgaatctttgaattgaactagagtaatttttaaaaggtgtgtaaacatgacaagtactgtgtatcctcattcccgcaagttgaaatagatcttcgctctgtgcattaaccttttccattatcatttatcacaactcacctgttaatatagaaatcaaagcttgatatccaatccatcctctatttatatattgttagcactgcctcagagcaattcggtatatttttttctgtccttatgaatgcccatatcttaaaactgtaaaatattcacatatatgagcacatttattgttttcttccaaaatatttgcatcctctaactcaactcacacttttcatttatattacaaatgttctccctaagtctgttataactgatcaggagagtcaccattctttcaagtacagaaattctattatcaagcatatcctaggtgtcaggaatagaaataaaagtttacaaagacagaggagaaaacttatttaaaggtaaaatgtatatatacctgtgcactaacttctaattttgagaacttgcaaagaatctttttcctcttttcttattcttttctgtcaaaacttagctaagtgactgcattcttttagacacttttgaagaagatgggaatttagaggaagctagttgattcagtttaagccacttggtgaaaccaaaagataaacataattgtgatatatatatcatttggcaatttattgcatcgctgcatgcctttcagcagaattctagccctgtaggatacacagattagttgaagtggaatctcctgaactcatggaacctacacagttatttgggagtttttggttaattgataaatggagttagaactgagtgggctcagtgtgggtggtctgagaaggcagtaatctgagctagagggaatctggtaacctttatgaagaaagctctaaaatgtgagcccatcaaaggcaggaatgtatatcttctatataatctcattgtttattactagtacactatataaatataataaatatactaggtcagtagtacaaatcattaaatctatgctaactgtagaaacagaagaaaaactgggtggaaaaattgtgttgaagaagactttaaaaagagaaaaaagagaatgaaaaattctgtctgtgtggtaaattagacacaggcacacacacattcatacaactataaaaatgcctcactaataaatctaactcatattcatttttatagtcgtattaatgtctatctgtgtctactttaccacacagacagatgataatttttcattgccttttatacacacatttatataatatttgtaaattatagagagacaacaaaatatttccttgttattttgtaaagctacggaagggatatttaaaggaaataaatgtgattaaatgtatccttgttgttgtggcgtcatttgaagccaaatgtgtctttgcagtaaatctaactgattttccactttcctggtaccattttaaaaataagccctatctctttttaaaataagtcttctattaactttgattccaaaaaattctactagaatgtgatttatcacatctattatatagagataactgaacaatatttatctccacataaacacaaaaccatttctagataagattaattcagagtaaatattctttccatgtaatttattgatatgttataatcctttaaaaagcctcgtgtatactctatgacaaatatgattcgcattataaaaatcttgctcatccatgccggcttaataaagggaagtacagttttgaaaacatgaccaaaaataattttgtcataaaatgtgcttgatgtttgtgtttgagaaaaaattttatgggaaaaaatatttactgccagctcaattgagagagataaactatctcccaatgagtgatatgatggttttgatcctatactgaatttagtaatcatctttatttccatactcactcttctgtctgatttttttccaacatagtatgcatgtttgacttaaatgaagtagaaatgcataattagttttgtctaatgtcttcacaaaagcccatgatatgatagtgttcctggaccaaactgaggattgggctgcttattcttgtggcccaataacgagatgcagatgaacgggaaaaggagagagtttttatttctgtaagtggttacagggagaagacctggaaattatccccagaccaactcaaaactataaagttttccagagcttatataccttctacgctgtatgtctacatgtaagtgtgtatccatctaaagacataaatgattaacttcttctgatctgtaactaagatctgattcctgaagacattcctctggagcctcagtaaatttactttatctaaatgggtccaggtgctgggatgattacccttatcttatctccggctaaatcatggagtttgggggagttccttcagatgcccagtaaacttgtttgtggagtcctggggagtttcttcagacccccaataaagcttttttaattctaaaagggtcctgttaagaattccttcattatcttgtcatgcttcaaggcccaggaaaggcctgggcaaaactcttggtgggcttttgttaccgtccagcctttgtttaagggcgctggctctatcagcttttaatatgtaactttaccactcagtcagtgctgaaacagttgttgtggaggcctgcattagtgagacctggcctgccacaatagttcatttacctcttcattgccgcaacatatatgtccacattaaaaatccaggactcaccctctttgggcaatatcatgtgataaaataaattgatatgacatacttcttgcaagatttctttttaatttaccttttagccagcatgataagcatgatgtagggtaaattaacactaaacttttgagtcagtaaggtagcctttctttttttaacttttattttaagttcaggggtacatgtgcaggtttgttatataggtaaacttgtgtcacgggggttggttgtacagattatttcatcacccagatattaggcctagtacccattaattatttttcctgatcctctccctcctcccaccctccaccttccgataagctccagtgtgtgttgttcccctctatgtgtccgtgtgttctcatcatttagctcccacctataagtgagaacatgcagtacttggttttctgttcctgcatcattttgctaaggataatggcctccaactccatccatgtccctgcaaaggacatgatctcattctttcttatggctacatagtattccatggtgtatatgtaccacattttcttggtccagtctatcattgacgggcatttgagttgattccacgtctttgctattgtaaatagtgctgcaatgaacatatgtatgcgtgtcttataatagaatgatttatatttctctgggtacatgcccagtaatgggattgctaggttgaatggtagttctgtttttagctctttgaggaatcactacactgacttccacaatggtttaactcatttactctcccaccaacagtgtataagtgttccattttctccgcagccccaccagcacgttattttttgataaagcaggcttcttcacactactctctaccttaggagaaaacgttatatccatactttaatttatttgaaaagaaaggtgaatataaaattgaaattctctgagtcttatttttcttatatgttcttgcctacttgtaacaaaacatataataaaagggcattataaatagtaaatcatataaacacaaaatattcccatttttgtcattatgtaatgtattttctgaattgaattgaaaaatgcatatatttatgaatttttttctactgaatctctccttcttatttacttctattcttttccatgatgttacctggtcttcttgagaacatgatattttaattgtaatcattgtgttcctaactccataatttcatgatgctattgaaatgcacatgaattttgattctataacctagtttgtaataagccatatttccttgtttctctacattggttgaatctgttcctgcagcaactagtaaccccaacaatctgactggtgagaaattcaatctccgtaacattttgcattcttctacttcttcccacttccattccaaagggccaggtagagtccagaatactgtaagtgtcctggttttcagtgcattttggtcatagctgatatgcttaatagccaagtaaacatgactacataaaggacagcttgtccacaatgccctgccttgcttgaacacggaaggttttgctgatgatgctctgtgcttggtatctggcctctacagccatttaagtaggttgtctcagcacaacatttggaaactctgtaaagggagtaggatgttggccttcacaacttcatccctttccctgtgtttgaggaagctcattaaacctctctttaatctgactgattgcaaatttccactgtccccgaatcttaactcccatatcccaatagcctgttcagttgggacaatatatcaatccttaacatgaatctagattttcagaactaaagtttttgaagggtgattttcctctggatacttgttcatttctttattgattatggttttggctaccttcttggcatcaaacagggaaaacagagcatttattcatgtgttactatcctattacactctgtatgccaattcatgtcctcaacacgtacacacaaacacacacacgcgcgtgcgcgcacacacacacacacatacatatacacacacccagtaaacatattctatatttaaaatgagcttagaagtttttaaaaaaggatgatactgggacaaagtggcaaaacattatttcagtgaaggaggtaacaatatatatgtacctttccattgtgtaagtgaattctaaatctgtatatagctaacacatttatatataactattgtgcaatgtgcctgctttaacagaagtaatcgagcagagctattgtgccatggaaggttttacatagatctaaaatggctcctgtgcccctggcttcctgtttgtttttatctgataataggaagaattaaatcattagagcagatgacgtacagtgaactatgtctctggatgctgatgagcagcctgcacaagactttggtaacaattgaattatttagtgcaattattttggagagatgaatattgatacaggaaacttacggaaatcctcgtttcagaaatagtgaggattgggaactttttgtttatgtataccatgatgttaataatcctactgaaaattatatgtatatggttagttgctccaataatcatatgatacaagtattcaagatgagtaaaatgtgaatttatgtggcttgctcacagtaaataggagagatgaagctaggacccaagaaaatggactctaaaactcatgatatttccatacctattattgttgggacaaaaattccacctacccaataatgcatttttgggacaaatcatcaaattgataagtcctatgagaagcaggcaggggggttggagacagtgaagactcaataacaggtggtattaaatgctcgcttactcacagaggatttaatctacctttgaatgtttagtaaccccaaaatgcaaccattgtttaggaagttttttagttgattctttctgaatgatttctaatacaaatgcccctcaacttgtgtggttaggtccctataaacccatcataagttgaaaatatcacaagtcaaaaatgcctttaatatacctaaccttcgaaacaacatagcttagcctaccctactttaaatgtgctggcttaacactatcctagagctgggcaaaatcatttcacacaaacctattttataataaagctagctcatgtaattgattgaatactgtactgaaagtgaaaaacagaatgcatgtatgggtactcaaaatacggtttctactaaatgagtatcaccttacactattataaggtcaaaatatcttaagtcgagaactgtttgtactttaaatgttaatattttttacatactgcgttttggtgagtgaagtaaacttagtttgcagtagagttatctaaagtgatattgtcattttcaaacattgctttttatttctactactcataaacaaattattgtgtttacatgattatttgaatattaacttaaaacagttttatacgaaattcaaaataccactttactggcatgtgaactccctaacatctacacttggtgttaagatgacttgtcgaatgatgtgtttgtgtttggaatcaagatgattatactaaatggtttaatctactgagaaccattcccttgaatgttttcctgaaacaatctttgcaaagtacctaagtaacaaaggatattactcagttagtgagacaaaaatggattgtgataggtctcactgttttcaaagaaagacaaatcacttattgttaatagtaaagaagtttcttagaaatatgttgctgtttatcaacccagtgttactgagatcttgacaattccttttagaaggtaaatgttttggtctctaggttatcatgtcctgatacaagaaaattggaattattgattacacctatattctctggagtggtctcagtgccaagcatatttagcttgcatatgtaaatatttaccaattagcatgatagttgctagcaaaaaaaccaattctttatggctgatgggcctatccattatttatctgattttattttgctttctagcaaaacaacatacatggacattagtgaagcatttttatttagaaaagaacaattgacactctggtaccatcctatcagagatatatgtttactaaaataacctttcaacatttaacaaatacttattgaatgccagctatgtgctaatcatactgtcatacagtgatgaaggcataacccaacatggttttccctctccaagagattatcatctgagaaaggaaacaattgcatcaacaaataattaaaataaaacataatctttaatgcaatagaaatgctgtgggaacatagaagacagaatgactaattgcttggagaggataatagctttttaaaatatggtgacatttagtctggtgttgtctacgcagagacaatttcaagaaagatgaaggcagaaggaattgcatgtagaaatgtgtaataatcaaagaagtatgacttgtcaggtgagtagtagcaagggagatctttaggagtgaagaagagaggttgtgagagggcatataatgccattcttgaagaattatattgttgtggggctggttgagccaacaataagataatggcttagtcatgttaatttgcaacttctgattgaagactgtgaagctctaaaacaacaggcaatgatagaagaattagactgccccaccaccactaatgcttcatgcaaaatttggtctgaagtctaccctttacatttggcaatagacatagagacctaaaatggaaaagcaagcaggctaccatttttgtagagttgtttgataccatgcacactccaaaacgatgcagcaaaacgcattggaattacctagaaaatgtgttaaaacatggattgctgaggcccatagtcagagtttctaattccataggtctagggtgggacccaggaatccggatttctaacaggtcctcaggtgatgctgatgctgacggccaaagaaccacactttgagaaccacagtgttagaatttcagtaatttaatcaggtctgtagtagagaatgttggaggaaaccccactgaggaatttattgaaccctcaaaggggaatgacctttttccagttgagaatcaatgcaagtacttgatttaaattgggatttattttgtggggactatactcaaaaactgaatgagttaaaagactcaaaatcaatcaatctgatactgattgagcattcttcgtccaaaacgtttgaaaatagaaatgtttcaaattttggattttcgtttggaatatttgcattatacttactggctgagcatctcaagtccaaaaatctgaaatccagaatgctccaatgagcatttcctttgtgtgtcatgtcagccctcaaaaggtttctgatttgggagcattttggatttgggatttttggatttgagaggctcaacctatacctattttttaaaaaatgtgtatatatatatatatggatatacatacacacatatatatgtacatatatacatatttatacacatatatgtacatatatacatatttacacacatatatgtacatatacacacatatttgtacatatatacacacatatgtacatatatacacacatatgtacatatacacacacatatgcatatatacatacacaaatatatgcatatatacatatacacacatgtatatatacacgtatatatacatatatacacacatgtgcacatatgtgcatatacatgtatatatacacatgtgcacatttgtgtatatatacacgtatatatacacatgtgtatatacacatgtacacacatatgtgtatatacacatacatacgtgtatatacacacatgtgtatacacacatatgtgtatatacacatacacacgtgtatatacacacatgtgtatacacacatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatacgtatacacacatatgtgcatatacacatatacgtatacacatatacacgtatacacacatatgtgtatatacacatacacacatacacacatatgtgtatatacacatacacacatacacacatatgtgtatatacacatacacacatacacacatatgtgtatatacacatacacacatacacacatatgtgtatatacacatatacatatacacacatgtgtatacacatacacacatatgtgtatacacatacatacatatgtgtatacacatacatatacacacatgtgtatatacacatatacacacatatatacacgtgtatatacacatatacacatatacacacatgtgtatatacacgtgtatatacacatatacacatatacacacatgtgtatatacacatatacacacatacacatatgtgtatatatacacacatacacatatatgcacatgtgtatatatacacatatatgcacatatgtgtatatatacacatatatacatatatacgtatatatacacatatatatacatatatacgtatatatacacatatatatacatatatacgtatatatacacatatatatacatatatacgtatatatacacatatatgtatatgtgtgtatgcatatagacacatatacatatatacacacatgtgtatatatacgtgtgtatgtgtgtatatatacacacgtatatatacataagtgtatatacacatatgtatatatacgtatatatacgtgtgtatatatacatgtatatatacatatatgagtatgtgtatatatacacgtatatatacatatatgagtatgtgtatatatacacgtatacatatatgtgtatatatatacgtatacatttatgtgtatatatacgtatatatacgtatatatagttgttttaggttataagacttaaaaatacttatctgatgtatatatatatttttaacaatcctagttattttgtgtttcagggcagataggtgatgaataaagatattaatataattgtgttcaaaggttagaaaaaaacagttcgttgtggcattactattgactgtatccgcaaatttctttcactgcaatcctttcatgggctactatatatttttcttaagaataaaacatttccaattgacctacagagtctttcaatctctcttttgtgctttactttgcttcagcagaaggatttcattttagtgacactctgaaggtcttcctctgtgcttcacttaagggtgttgcatttttaaccttaccaagattcctatggattcctagaattatatttcaaattatgatcatggtagccagaacacaaagaattaagatctactctgacagtaatgtactgatataactttaactgtagaaacctttcttgtaatgcacatggagggcagacttgtatgtatcttggaacataaaaggcagagtatggtttttaaaagggctttgcttatttgtatcctaatttagctaatttcactatgccagttctatatgcagagataagtaatagtaaaaatggacaaaaagtgatcaataaacaagtgatcactttcggtcttgtccagaattgtggccaggtgatgagtgcaaactaagagaccttttcattagaaatgtgtgaagttactctttggtttagcattagctgtcttttaatgagaacaaatgagagttgcagatgaatttgctaaatgtttctttctttgatttagtttacctggcctgaagaaaaaaaaatgtcttcgatctacaaggtctacggagagtacttttcataggaactagtcctattaaaattacctgcagttattatgtcagtcagagaataaatattttgagtatcatatctgtacttgaagttcttatcctttacaaataatttatatttaaggaaacatgctttgacagaaatacacatgaagtctacattctctatctatttcatatcaggtgctctagtgttttgaatataacagttaagagatcaagtccctttaatcataaggccctgttagctagcgagctaaaccaaagagggaaacatttagcaaactatctgacgttctctatatttgtttgtcaacttgtttgttttttctctctgcaagtagaatatagaatttcagagagtgacaagtgctaagagaaaaaataaagcaggataagggtagaatagggatatttcaaagggtaggttgccattttatgtagtgggtcctggaaaagcctcacttaagaggcatacaaaaaacctgaaggaaggaaaggagggcatcttgcaggtgtcttggagaagagagttctaggcagagggaagaatatgtacactctgaggagggagtgcgtgtttgtgggataacaagggagtcaagatggctggtgcagagtgactgaggaagagcggtaggatctgcaagtggagtggtattagaaggacaaatcagatagggccttattgaccattgtaaaggtcttggcttgtacattgtgggagattaggagattttgagagttctgaacagtagccagaaataatgtaagttagaatgtaggatgtaaaggtagaagtagagagatgagttagaggataatgtagtaatgaaggctgggtgtgtgcgtgtggctaggattaggttgatgtccatggatctggggagaaatgatcgaattttggatacattttgaaagtagatgtaacaggatttgctggtggactaaaaatggagattgagagagtggagaaaaacagttttagcttgagcaaaaggaaggatgggatggttatttactgggataagaaagactattgcaagagagagtttggtggcaaagtataggtaaatttcccatggaaaatcattgaaaataattttagttttagtatgtttttatggaaggagtatttattttcaactcctaaaatttatcctcaagaacaagaataaatacatttatctctattaaaaaataaggaacaatgagagatgatacaagtgcctctagcattgtatgagtgtgtacaaccagtgaacgttaacttgtaaatccagtagcagtaacttgatctttgtctctcttctgatctgatagagtgcaaggtctatgtctacattcatttttttgcatgtagatgtccagttgtttcagcattatttgttgaaaaggctatctttgctccattctattgccattgctcgtttgtcaaagatcagtaaactgtattcatgtgggtctatttccacactattctgttctattgatgtatttgtctattattttgccaatacactgtcttgattactgtcatttcatagtaagtcttgtagtcagatagtgtcagttttccaactttgttcttctccttcaatattgtgtgggttattctgggtcttttgcctttcatataaactttagaaacggtttgtctatataaggcaaggtaacttgctgtgattttgattgggattgcgttaaatctgtagatcaacttgaggagaactgacttctttacaatattgagtctttctatccatgaacactgaatatttcaccattcatttagttcctctgataactttcatcagagttttgtagttttcttgtaaagatcttgtatattttttagatttattcctcagtattttatttttgaaaatgttagtggaaatggctttgtgttttacatttcaaattccacttgttcactgctggtgtgtaagaaacaattgaattttatatattaatcttgtgtcctgcaactttgctacaattgcttattatttccagggttatttttcgattctttcagattttctacatagatggtcatgtcatctatgaagaaatacagcttcatttctacattccaatagatatgtctattttctttgtcttattgcattagctaggacttccaatatgatgttgaaaaagagtggtaagagagacatttttgtcttgttcctgatcttcctgagaaagttttcattttctcaccactaaataggatgtcaattataggtgtttttgttcatttttttatattgtcatgaccttgttttataaaatacaattatttctctcctaactttctgtggacctcaattataattttcccataattctcttctgcttgcattgctcatgttttctgtcttcttcccatttgttcttatttgctttattttgaggaactgtttctcattattgaagtcattcctcaaattacaagtgatcttagcttttggtttatatttaagtgtgagatactaacatttgataaaattaaaatctatttcatgattaaagtacatttaatataaaacagaattgaataattttgttgacatattatatatatatatgcgtgtgtgtgtgtgtgtgtgtttgtgtgtgtgtaaagtccaaaagtttgtacattacttaaagaagaaacatctgatgcattctggataaagacaggaaaaccatatgagtactacagctacctccattaatacttaacattgtgttgaaaatattagccattgcaaccagacaagataaaccaattcgaggcaaaacaattgcaagcagtggtaatgggatcccaatttacagatagaattgtttacctcaagagatcacacaaaacaataatattaacaaacacaaatatgaacacaaacaaataccaataaaataatttagtaagttagcagactataaaatttacaggcaaaatcagtaaaattcattttataggtaatgagctagaagtttttatggatggtgcacacccatttgcaacaatagcaacaacagcaaaaacaagaaacacatttaacaagaaatttcagtacctatgtttaaaactctcctgaacaacccaaaaggaaatcaaggagaaagatgctccttgttcctgaaaagcatggcttaacattataaagtaaactattgtttttaagttaatgtgtaaattaaaggcattccaatataataagtagtatttttttctggagttggataaattgattataaactttttataaaaaaatacacaagtaaaaataaccagaaaaacactaaaaataaatatcgatgaagggatagggaaacataaaattataaattaaaacttagggaaaactatcatattaaatataaattttcaataaaaactaacaatttgttaaaatgtgttttgtaaaaatatatttctatcagctgggaaggtctggtagtaatgagtatacctagcatgcagatattcattggtaagtctcattccacactgaaagaagtcacagctcattagaagaatatatgatacttcatcctggccaaggaacatagtgggtgagcctgcagcctttgttagagccataaggcaaggaagtacttcccaaaatttgctaacatcttgagttgttcatttttcttctcctgttttctttatgcttgtagagttacacctttttaaaaggttttcttcctgtcattttattggaaaggcttcaaataatttttaaaacatatttatagatgttcatactcatatattttcctgatactgaaagagaaatttatgcatttagtaacaataaatgttggcctagattttctctgatggtctcttcaagaatctggagcgttctctatctccacaaaggatggaaatgtttcatttcaatatgccagttttcaagtaaatgtgatttagtttctctcttttaagaataaagtcatagcagaatgctttatattactgattgtagtatcataacttacttctgaaacatcgaatacaattttggaaggtcagcaatgtcctgttaatatttaagtatgcctcactatataatatgtgcatacattctggaagaagcatttaaaatgaagactgtttctaataatatattaaacgagctatgtaagtagagttttatgatagctgatattgtgattttattcagagactatttatataagacatttcagcatatctgctaaagaacaaacctatcatctaagtcagtaaaccaataatttgaattaaaaaaacggacaaaaagaaaatacgaagcaacttgaaagatcattaaatacactgcctgatagttaagattctaaacagttacattatatgaatagtttactgtatattatatattttctatttccactttgttataggtaagctaatcagatgtctcaagttataaaataatagcactaacttataaaagaagtgctacctttcttccactccccaaaatacacaagattttattcttcataaatgataacatttgttgtttgttttctgtggttgaaagggaagtacaggaatgaaataatgtattttgcaacaacttggatagaactggaggccattattctaagtaaagtaattcaggaatggaaaaccaaacaccgtatgttctcactcataagtgggagctcaactatgaggatgcaaaggcataagaatgatataatggactctagggactcagagcagggggaagggtaggagatgggtgagagataaaagcctacatattgggtacggtgtatacttctcaggtgatgggtgcaccaaaatctcggaaatcaccactaaagaacttacccaggtaaccaaaaaccacctgttcccccaaaagtattaaaataaaaaaatttaaaattttgaaaaattaggaaaaggaagtacattttcatgtgttgctctgttttagcacacctggtgcagaggtccctgaggaattttttctttttcttttttcttttttcttcttctttttttttttttttttttttttttcgagaaaaaaatatcacacatttgaggcaggagaatagggtctggaggaagggaacctaaggccatttcacgctgacttccctaggactaaactgaaggcaaaaccctaactttccacccctaagtaacataaggaccagaggctactccctttgcaaacctcccaccttttctgtgtagcagatgggaaattggctgttcccaaccaatcagactgattgcgggcccagtctttgcacagaagtgcaactttgtaacttcaccttagcctctgattggttgctttttgcaaccaatcagatgtttgcacaggagagtgtcctatgtaactctacttcagcctctgattggttgctttccacaaccaatcagaccaattgcaggccaccacttcatttacgtggggtgagcatgaagtggccaatgggaaacctgtagagggtatttggaccccagaagattttctttatctgggcacttgagccgctgctcagcccgctctcacactatggcatgtacttttcattttaaataaatcccttcattccttccttgctttgtttgtgcattttgtccaattctttgatcaagacaccaagaacctgggcaccctccactagtgacacactgataagatcttattatattgggctgataattcacctacacttttaccttctgaatagaaaaggcacttgattagagatgtatatatctaggtgctgggatcaactatgccatttgcaaagtaccttacttcttgagcaagaaggtaaccaaaaggggaatgaataggcaatataatttcttttaaaaatgaattagtaagctcttgtggttacaacaagaggactgttgttttggttctttcacaattttctatagtaaaatttgttagtattaaagtataatgttgatgcctatatttttaaaagatataaaagtagagattttaaaagagaattaaaaaggttttgagggaactgttttagattaagtaagataatgaagagaaacaatgcttaaaatattagaaaaaaagacttatgagaaaagtcagaagtactgaaactgtctagccaaagtagaaacgaaaccaaatgatacctttctcattcatattaattatttgaatgctttggttttgtttttctttattttatattctgttagacgctgtctttcttgtcttcaaccaattcttttctatgtaacattagacagtgtctaataataatacacaaaacaaaaaagttgtaaagaaaccacccacattttctcttcaaaagaaaaaattgtctgagaactctgaatgtctaaagtccttgaataataatgggaaatggaggatggttcatgagtgtttttcagtattagcaaaagactgacaaaagcatgagtttatcaacaggaagtacatatagtcagacttatagactgaaactgttcctaaagctgtgtgtccctgttttagaactatcaccacagtcactgaagccctgggcaattcacagacattgcaaaatcaccacagtccctgaaggccaaagaatgagacacaggagtcttttatcatttcataactcagtgtgcccattcttcctaataggcaggacccagcatctgtggtcctcaatacaaccatttagaaagtcacattgtagtcactccttttgcttgttctggcagggactgaagttggagcacaaaaaatcttgtaaaattcagttcctatatcagggtgtttccccctttttatcatgaagtcacatgtcccatcctgtgtcttaacagtaggtgattattagaagagtagctggcacacagtagatttataataaacaatggaataattagagtgcctagcgcacagtaaatttataataaaaaatatagaataattaatgatgaagaaatgaatggtagatgtagtagaatagaaagatatataggaatcctgagaagtttggcagcacatccaatagaaatgtattgcaaaaagtttatatagtatttacatttcttatagcctcatttaaaaactgagaagaaacaggtgaagtaattttaataatatttatttaactatatgtaaaacaaaaatattatttcttcaacaggtaatcactatatcaattagtattatttattgcattatttattgtaccacctctctaaattccgttgtgaattttacacttccagcaaatctcagcaacacgggatagccactattcaggtgctccaaagccacatgtggctagtggctaccacattacacagcatagctatagaggggtcttagaatattctgactaagtcaggaagggacttttgtcacctccaccaacatcccatgggtcagaacccagttatatggctaaacttaattgcaaaggaaactagaaaatgtaactatagaggaatctttaagaaactattggtcagacaacctaagtgtaatgtgacaggatattatctaaaatcttaatttgaaacaattacatatagttgatataaaatgcataaaatagagaaggatgtactatttttgaagccaggttcaaagtgtatataatgaacactattgaacaaagcaagatttaaaaaaaattgtgaattgaataaaatatgtatagtaaatgtacactctattatgtaaactaaagtatgtttagtataaaaacacccctatactaaaactcctttcaatactccaaagcagtaagaaaaaaaacacaaaatatacatttaccaatcttaatagtctagcttataaactgatatggaattcgttacatgatccctgtttgaacattatgtaagactagcccaggaaatgatatggaaaaaggaatgaaaggtaactttcaacgaagttacatgggagagtgatcaaaagaaaatgtgactttttttccttaactcaacacgtgtacgtgacgcttcaagtatgcaacaatggatctgtgctcaagtcaaatgcacagaccagaaacagaaattggtcagaagacatttcttgttttttcggttttttttttgttttttgtttttgtttttgtttttgtttttgagatggagtctcgctctgtcacccaggctggagtgcagtggcacactcttggctcactgcaacctccgactccctagttcaagcgattctcctgcctcagcctcctgagtagctgggactacaggcacgtgccaccacacccggctaatttttgtatttttagtagaggcggggtttcaccatgttagccaggatggctcaatctcctgacctcgtgatctgcccgcctcagcctcccaaagtgctgagattctgcgttggtcatcaatgtttaaacatgttaaacgtaacatgttacatttaagtaacaatacctacataatcatgtaagtacattcattgccaacttaaaagggagtcttcaaagcagaattgtcagaacttttagcttccctgggccacactgggagaattgtcttgggccacacattaaatacagtaacactaatgatagatgatgagctaaaaaaaataaatctaaaaaatatctcatgatgtttcaagaaagtttacaaatttgtgttgggctgcattcaaagctgtcctgggcctcatgcagcctgtaggctgcgggttggacaagcttgcttcaaagctaacattttttctccaaaattttccctactgctatcgcgatcaatttgtttcctctgaagtgactgattttaactgagatatttttgtttgtttgttttctggttctgcatgtataaatccttcgaatagtgtaaggacactgaatttccagcaacttctgtttcgaaggttcacacttcaaactataacatgttgtgtaattattggaaaagtgtcctaaagcttccattattagcctataaactatagttttggaagagactttgcccaccattttacattactagctgtgagtgcctaacatttagtaagtacccaagaaatatgaatgttagaataaagtcatacatataagaaattctttacattgttcaactactggagaatatgttatatgtagtgattatttttaaaagcattataaaaagcatttcaatttgttcaagcatctcaataagttagttaaaatacacagaaaatgaataaaacaattagaatatatatgtagcatttgtgtgtgtgtgtgtatataaacatatatatgcaaatgtgtgtgtgtgtgtatatatatatataaataggtagagaactttaaagtaattaaaatctgaatgtggttagctcaagtcaggtaaatttgagaaaatctttacaaaagccatttgctcatactactcactctcagattagttgttcatcaggtaaacaatttgctaaataaacatttaaataaaagaaacacattgcataggggaagaaaacataattttacctctaccttgattttttttttttttttttttttttttgacactgggtctcactttgtggcccaggctggagtgtggtaatgcaatcttgtctcactatagcttcaacctcccgggtttgagccatccttccacctcagcctccccggtagcttagctacaggcatgcaccaccatgccgggctaatttattattttttttactttttggagaaatgagggtcttgctatgttgccaaggctggtcttgaatgcttgagctcaagtgatccttcagtctcagcctcccaaagagctgggattacaggtgtgagccaccgcatctagcctctacctttatttcttaactgggactcctataacaaaagagatatcaacaagaaaaaaacaataaagtttactaacatacacacctcatgtatacatgaaagatatataaggaaaaatgaataaatttctctgacaaagaacaatacgttttttgagaagtaacaagacaagggaaaaggaccctgagtctctatgagtggccaatttcaggaaggcaaatatatgggaaactgatggtagataaaggctagttaagaaaatttattatgtagattcctctgatgcagtctccgggctgataaagatctaaagttgtcattggtgatcaaactttgtcctttctgatagagaggagaggatggacacctttgcaaatgtatgtactgttttcaggcaaatagtgggagggcagagaacttatatctgcttcttctgaattgcctttagctcaaaatagtcctgtgtcaaagtggcatattttcatgaacatagagaatggaataatagacattggagacttcaaaaggtgagaggggccgggtgcggtggctcacgcctataaccccagaactttgggaggctgaggcaggcagatcacgaggtcaggagttcgagaccagcctgaccaacatggttaaaccctgtctctactaaaaatacaaaaatcagtcgggcatggtggcgcgtgcctgtaatcccagctattcaggagaccgaggcaggagaattgattgaacccaggaggcggaggttgcagtgagccgagatcgcgccactgcactccagcctgggtgcacagggcgagactccatctcaaaaaaaaaaaaaatggcgggaggctctcatgtaccccagaaatttatacacctacagtgtacccacaaaaattaaaaatacaaaattttttaaaaggtgagattgtggcaggggagtgaggagtgagaaattacctattaggtacaatgtacactattggagtgatggtttcactagaagaccagacatcactactatccaacatatgcatgtaacaaaactacactgtacctcctaaatctataaaaataacaacagaaaaaggcaaatatacatatgctttcttatagattcattaatctgttttatttcagtgaatgaaaacttttgacaatggctaaccttgaaaatatgttattagaacatgtttttctttctccattgtgccctatgagcacaacttgagaaatccagcaataaaatgcaagctagtttttttttttttttgaaacagtcttgctctgtcgcccaaggtggagtgcaatggcactatctcggctcactgcaaccttcacctccagggttcaagcgattctcctgcctcggcctcccaggtagctgggactacaggtgtgtgccaccatgcctggctaattttttatttttggtagaggttttgccatgttggcccggctggtctcgaactcctgacctcaggtgacccgcccgcctctgcctcccaaagtgctgggattacaggcatgagccaccgcggccatcaagcctgctttcttgacatattttgtgacatattttgggatggcatatttcggtctcctacagttggcagggcaatctaaagtactttaatatccttcttcatgatactttcaaaaaatggaatttgatgcctcagaaaacaatactaaaactttcttaaaatattacaatgtgtactatattacttttttaagtaataggacttataaatatttatttttaaaatttgtaaatatttaccatccacctttgattgaacatttttttctcattattttatccaaaaatgtctattgagacctttaaaatttgtattttgtggcaccatctaagacgtgatttatgctccttgtcattatttaatcgtcaaaatgatactttgtctttgcttaaatcagtgtgggtacatcgaacaaggtttgagagctactctgtaggactgagtcattagcctgtaattttacagcggatcaagtactacgttttcattacttggaaagaaaatgaccttgcaattgactcttacatttaacgtttttatctcagctttaccaccattaaatataactgtttgcactgaccacataagaaaccagaaaaatcactgggtcacagtttaatctaattcaatttaaatccgagctagatagctataattggcagtttaccatatcaaaggccagagttaagttacactcaaaattgtgttgatttggaagtaatttgccttaaattttcaagcattgttctgggggtactaaaatgctctttcaagagtttactatatggtacgtaatattttccaagtgttagatgatttatgaagtctacattattatctaaaacaaccaatgttgtaactaccatacaagtctatgaatagaccttatttcacttggcctatctcagggtacaggatcccagccttcttccgtggcaatatgcaggctgttcctcagcaacgatttctagtattgtgtgaaataatcatacttacaatactaacttcttgcttcccaatgccaagaacactcatcttgtttctattgaataaggtgacaggcatgatagaagcagggcagagccaagtcctgacagtaacatttcaagtacagagaaattcatatgagaaaaatggacaatgagggcttgttgtccgtgactttttgttccatgaaaaatatgcctgttagcaaaatcacataactaggaattttagataaagtttctatgtacattatttaaaagagtgctttatacggcatttaagttaaaaagaaagaaaaaacattcacattaaacctaaaagtaactaaaaagtcatagaacagagatgtcatacagatggctagcctttattaagtgtcaagcattgttataatggatttgcatgagttctttaattgcatttatttatcttgttttggtttggtttttgagacaagatctcacttcgtcactcaggttggagtgcagtggagtcattgcggctcattgcagccttgacctccaagccatcctcctacctgaacccccaagtagctgggactacaggtgtcccccaccatgctcagctaatgttcctattttttgtagagatgggggtcccctatgttgcccaggctggtctcagactccatagctcaggtgatctacctgctttagcctctcaaagtgctggcgtgagccacggtgactgaccttatttatttatttttaatgaacaagtaacagttgagtaatttatggtgtacaatgtgatattttaatctatgaatatattacagaaacattcaatcaagctaattaacatatctatcacctcactaacttatgttttgtggtcagaatgttgtctactcttggtgggaatgtaaattagtatggtcattttggaaaataatatggagattcctcaaaaacctaaaaatggaattaccatatgatccaactttcctacttctggatatatatccaaaggtattttaattgatttgtcaaagatatatgtgcactctcagttaattcttaaagcaacgtactgagatagacattattagtatcctcattttacatatgacagaaccaaagcagagaatagttaaataacttgttcaaggctaaacggagaaagaatcaggattctttttaatattttcaagattcccaagttcaaatgattaaacaatctattttttttttttttttaaattgggggcttccaccttttttatatttgttgttagtgggatttaggacatatcatccccaaatatggcaccttggcatttcgggaaacagcggaagtgagaaagtctctgaccttctgccaccattttcctctgaagcagatcagaaaagaattatctggccttgctctgaagtaggccataagacccctcatgtgtcccatacctaaaggaaaggaatgtcacactgggacacagagaagactgaacaaacaggctttgctacattcccccccaccccaactttattaccattagattacacccttttgttctccaatcatacttctgccaggttgtccactcttcatcaaatttagcataaaaatacacaggtctcccctttttctttaggtattcatttctgaatgctcctgtgtcctggtatcatttgtaaaatttatattaaatacatttgtatgcttttctcttgttaacctttcttttgctataggggtctcagctatgaaccttgtgataggcgaggaaatcaattttttctcccctacattgttcacaatccaatttaagagaaaaagtgagcactcttgatgatccagtaccccccaaaacacacagacacatgcagaaataaaacaaaagttttataaaaggtggcatttttagtatatgtagccacactttaataattttatttcattcttttctatttgtttttttttttcctttttttgagatggagtctctgttgctcaggctggagtgcagtggcatgatatcagctcactgcaacctctgcctcctgggttcaagcaattctcctgccacagcctcccaagtagctgggactacaggcacacaccaccatgcctggctaattattgtattttagtagagacggggtttcaccgtgttgcccaggctggtcttgaactcctgaggtcaggcagtccgcccgcctcagcctcccaaagtgctaggattacaggcatgagcgaccgcaccagccttctatttgattttttacattaatggcagttatgacacataaacgggttgtacagctcacaaatgtcttgacctatagcttgaagagcatttgtctaaatgacttgctcaaactacttactcacaaatccgggttctaaagttaggttttttggtttaaaaactgtaggctttttcctcttggttttataattgtgtcagtccaaaaattcttcatttcctaacttttctccatattagctataaatcagaatagttgggaactaaatgggagctttgccaaaggggcaatccccaactacaatgcgttggtctaatattcagtaaaatacattgattttagtaaaattcactgcatattttgcattttactcaaattcaatataaaatagacagtttttttttttttttttttttgagacagagcttggcttttgttgcccaggctggagtgcaatggcgtggtcttggctcactgcaacctctgcctcctgggttcaagcgattgtccttcctcagcctcccaagtagttgggattacaggcacctgccaccatgcccagctaatttttgtattttagtagagacggggtttcaccatgttgaccaggctggtcttgaactcatgacctcaggtgatccgcccccatcggcctcccaaaatactgagattaccccacctggccaacagtctgttcttaaagaaagaaaattaaaataaatataattactagattcagtgtacattttacttttgtgagtatcattcaggaattcttacctcagaaaacctggaaaaggcaagttatttagaaatatgaagaaatcagggtgttttattcttaatgaaagcatgcatcttaatttatctttagaaatgactgggggaagttgattatacaatcaaaatgattaaaattaggcatgtagactttagtgcaagcaaatctgggccactcatttccaggtacatgaggaaatgtactagcacttcttttattactatagctttgaaggcagcgtgttgtcttacttcccattgtttggatttttaaactgataattaaattcatttgcatcactgctgcttggattacaaatacttaaaacaattagttttctgtcagatcacagatctacatcaaatagatgttactttttaaagaataagccctcaccaattagaatgattcaaaagcttttgattgttttctccaaattgttaagtatgcatttgtctttaatgtaaataaatagacttaatggcataaaaagccattctgaattttaaatgaatgacaaaatgtaaatcatgttctggcataatagttttgccaaagtttcaagaaaagaaataggagcattcacaataagcaattgcaagctgtgaaatggcatattaaaacagaggattaagttatttttctagttagtttttggggaaaaaatctccagtcttgcagaaatggctaaataattgcatttggtatggaggctacttttggtcaaaattatgttaataaatatctgagttcctcacattaaagtgaagcaagaatctgtggcatttttttaagtcataaaacatttgtatgttggcttttagatagtaacaagatggcatccatttatctgtatgcttctgcgcatacaaccttatatgacatatgtaccaataaaaaaagtatacatgtattagtaattaaattctagacttgtgctgtccaatttggtagccattagacaatggcaaaaaattattttgaatttaaattagtgaaagtaaaagaaactatgttgttcctccattttgctagctacatttgaagtgctcagtagtcacatggttttagtggccatcgtgttatgtagtgcatgtatagaacattttttgttttttatcaccaccaaaaattctaatggacaatgctggtttagctcttcagtattgcaaactttagcctttaaaagctatttgcaattatttagcgtgtattgtttatgctccaaaatactttcatctcaatgtagaaagaaaacgattgcacttttgaatataagagaaatcaaatccttgatttttttctacataaaaacgtggaatttaaactgaattatttaacaaaaatcaaagtaccttagaaataacctgaaaagaaaaacaaattttagataatatatataattttgaagtagaagaaaactaagataaaacgtactgcatttgtatacttttatagttttctaattattattataattggaaaaaatgaattttaacaaattaggtataattatcactgtggtaagcagtctccagaatggtcccaaattaaggttgtctgattacggaataccatgttcttttaagtccagtaatcccaaccttttctaggataaagcttggtatatggaatcaagatatgtattcttgttattcttctgttaccattactgctgtgggtttcaagaacaggcacatacagtttctccttgtgtgacacaaaccttgtgtgaatactttttggtacgctttcaaactggggcagcactagatgaatgccttttccctaggtatgcctttcagtaaactctccaggtgagaggggtgtagtaagtactgctttacatggatctaagtgacatgatttgatcacagttcaggtggttgtagttatgaaccatttcatgttaaattaaggtttaggggtttattttctaaaataatgctacttacagtgacagcatagcatagaatctacaagttctaaagcaactcaataacttctcttaaatggcccttattattttggattagcattttggatgacaactaactccactccctctcttgaagggaaagagatttggtagaaataattgaatgaatcctggattaatctagaatatgattttatcaatgactgatgaattacactgcactcagttgataacggtgtcttcttctcttagaaatgttgagtttgttcctattattatttcaggagacaaagctttttaaaagagttggtcaactgtagctaggcatgaaagcatggtctctaagaagacacttataattccctaagtatttgattaaaaggaaaacaagtacctcaaaaactcttaagtttatgttataggcaaagaagtccccaaacaatttagtcaacactctgaaataaactcttaagagtggtgattttcacttggcattttggagattccatgtgtggcaatgtgctcctcaatcaaggagttacatttctatgtgcagtaacattgcagttgcacaattaatacaaaaacaaacatatattaatcaatgacaggttttctcattttcatacagagttatgaaacctttaggctaaggaacagaatagtgagaaattagacaactattaataataggattaattagattctggccctacagctaagaaaatggagtgacaatcagaataacaccaaagttttgcaagttgtccaagtgacaaaatacaactaattaatactaataaactaaagtcaaattggactctatttacacaaagtactttttatatacaggcaaaaatttaagtagaaaaattatggcctcccagaactaataccaaaaatttaatggtaagaaaatgaacgtattcatttaatatataaccacatcatttgaaaatattgagctctcattgtaaagacatgacattttctctaaaattaatatattccataaaaatagtttttaaaagagaaaggctttgtcttcattcttttcgtgtgaaggtcaaatatcttagattggaatttaactgcaggaattatgcttctgttcttactttagcaacactaacgatgacattttctgaagtacatattgttaacaccatcatgatgaaagcaaatcatttttctacacttactttgatgctaatcagagcagtcatttaagttgctacatgactctgagacagaaatttcaaaatgaaattgaccaccgattcccagacaaaaccagaatagtggtgtcagatgagaagggttttgcagtgttttgtcacatttcattttgatttttacttttttctctgtttgacatatgttctgaactagagtgccataaagttttatcaccataagtttgaaatgaccacattactcatgagctacagagtcacaagtgagtttttagcttctttcaaagctgtagaaataaaactttatagtaccctaccctggtatatgttgttttatgtgacacattttgttccactttattcttttcttttatttcccttcattattttctttttgaattatagcagaatttgtattaaatttttcctaatacacaacagtttaagctacattttataatatcttatgtatttttttcatacagattatctttgacctgtaatgcccatctcttaaagaaattttagatggtcattataaacaaggttcattgtgaaatatatttctgttgaaacactgattttattacaaaaaggtaatgtttgatttccatgagaaccaaaactattggttgagatatgaaagatgaacatttgcttccctttacacaattgattaaaattcttaatgcatacatagtcacactacacaattagtgtagtacatacatatccgtataacttgagtcttccatgtatatgttatgcaatagaacttctacaaagacatcaatatctcatgctgaaactatccaaactataaaatgattttaggattagcttatcccaaagggaaattgtgagcaatgtggctggcctgacagcctgaagtgatatgctcagagtggatctgataggcagccattcatttcaagctcaggaagcaaacttattattttgtcatacacggtcgtttttccattgaagacattaagacggtaaagaaagtcctcagagtctatggaaaggatcaccagactttcattttatctccagatcttgaactggagcttttgaagattccattttagtgatttctggaaggctgctaatcttaatgaataaagtcagaaacacatgtgtgtggctgattcagattccagaaagaattttggttgctatcatgattatttttaaggcataagtgattaacgctgagatatactgcttttcctatttgtggattaaatttcttctatcggagaagttctaattgaaatgtctccattcaatgtggttgtgcacacacacaagtacacccatgaatgatattttacatatgtaaaaaaagaaaaccgatattaagtaacttctacttttcattatgagacatgctgtgtgtgattttatatatatatatacacatatatatgtatatatgattttcctgtgttttgttaatcattttttatcattttataatttttaccattttcatcattttttattgtgtggctgatatatactagatattactcactcagggaggatacaccctcatctgggcactcttttatacaagttatggcttttgttttaaataattcatctaagtttaatgaaagaaataagtgactgctttatcctagagaagcagcaaagagattttgttcacctgtgcctttagagactacatgacagcctctacaagtagcagggtagaatcaggttgattataaaagccttcatttcatgctaaatggaaaggagaaaagaaagaattttctcctttaattagaatgtggcagtttaatgacagaggcactattgttgtgggttaacatggaatgaaatcaattaaataggactatgtatacttaggtgtctgtaggaatcaccaaaaatgtaactctccaacagtttgctgaatctgcctctgttttgtctggctgctatacttggtatgtgggccatctggctcctggattccagtaaggtttgcatattcacacatcaatcagaagtggtgtagggcctattaggaagcaccagccagttaggtgacatgccaggactgcaaagcactcaagcaggaatgccaagtggggagcttctgctgaagctgacgctgacacgggcattggaggcaccttttgatccgtctagctttactgttgatgtcacagtcctgctagatcaggcatagggatgtcaggtcacgtaaggcctcatttatgtcattggttttgcctggataattcaaatggagcaaaaataaaagtgatcttgatccttaggtcccatgacttttgatagtagaaggatcattgatctgaaattgtcttgcattcctgactagtagacagaaagatatcagaagcaactttgtctattctgtttctagaactatattgtgggtactagtttttcacagtagtactagacatttcagaaacagctaccgaataatctttccaaataaagggaaaggttgtaataaaatgcattcccattccctatgtcttctcaaacagttcactgaaacttaaagggatgagcacactttacaagaaatgcaaataaccttttagttcactgaaataagataaacaacacatgtgtgtatttttaattggaagctctatcattcagttccttgaactaacagctactatacttttcttttgatgtatgcttcacagatatccattgcaagttttagattgtttgcttcaatgtagataagacaaattaactgaaaacttaaaaagcacctagaggattggttattttaatgttttttagacctctggatgctttgatcccatacagaataggatgaaattccactataatggcattgttttaaaatttgaattggccgtaatgtgttgtgtgtgcacacatttatctagctatgaacacaattaatactcactgagagagctctttaaaatgatgacataatttttttctttgaaaagttatttcttacgccctaaatttctaaagtcaccaaaaaaaggtaattttctatatgtaagacttatttatagtaactaaatttctaagtaactgatatctcctaaacagaaatgtctaataacttacttctagatcagctttaacaatggttttgatttatctaacttagtgcagtaatacaaatattagtagtaaaataatacaagtttaactaacttggtataataataggaataatataattgctcatgtttgatgtatgctaactacttggcaccattaagtacatcacatgtattatttcacttttctcattaaaatagcagtgtgatgctattatctccattttacagagagggaaagtgaggcatggagagaagtcgcaatttagaaaagtaataagtataatacttattttaattttaaattattctttgctagaggaaagatgcatgttccttggacatcttctatactttaataatattatttctatgtttctagcaacccccacaatgaaaagcaaatacacgatgcctttgggggacaaagcagttctgtagtcaggcccacacatgaagtgttttacctttataggtttcaacaattaattggaataagctattttttctgttttggcatctgtctacttggcaaggcccccaactgtggtgttggcagctgcatgacagcgactgcctctggtttttccacagcaactggctgaaactcgcctccctgggctgtcctattatgttgaaaattattttctttgactcaaatcagaagagtgtaatagaaattgtgaaaattcctgacatcttcccaaagatgtttttgaaataggttaaggttctccgggagtaaacttggattctaaatatgattttttttttctgacagatgtatgcatgtgttatggtaggtattcagaaatgaatgctctcatttgtaaaataaaataaaataatcccaaactcttaactatagcaatttgtggttttaatcgttttcccttgtaaatggaaacttggtaagttttagagtgcattgtacatgataaaatacatcttatgtctaaaatcttagaaaatattatcttgcattggggaaaacatcataatagtgcatatgtgattcattttatgtaaagtcctaaaattatctaaattaaaatatctatattctatagctgtgcatgtgtgtatgcacacacaagaatatacacatctgcattttatatagatacaagtatattgaaaggatgatacattcttatacagatgtagagcttaggatttctttatcaatataagatagaaactgcgaaagcatgaaaatgaaattaagcatacttcctttattcacttatcacccgttttcagaattagttgccctatgggtaggtaccttttaaattatattgtacatctttcaattaaatatcgggaggttgaaaattaagtgacaattctaatatttctagtggaagacctgaagctgcactattaaaaagctagtaaatggaaggggaaggatatttctttatccatggagttaattacacaagcagtacactatgtaagtgctaggagaaaaggtgatacaaacactacttaaaaggtttccagcgagaagcagctctgaacaaagtagatttaaagtgttacctccttactcctacaaattctaatgggaatcaattatgttccatgagtaataataataattaatatttatggaagtgcttactatatgcttggctctgaaataagggcttcacatattatagcacataactatcctaagtagaagatactatttttacttccctttttatagatagggaaagtaaaacacagaggtgggccgggcacggtggctcactcctacaatcccagcactttgggcggccaaagcgggtggatcacctgaggtcaagagtttgagaccagcctggccaacatgacaaaaccctgtctctactaaaaatacaaaaattagccgggtgtggtggtgggtgcctgtaatcccagctacttgggaggctgaggcaggagaatcgcttgaacctgggaggcggaagttgcagtgagccgagatggcgccattgcgctccagcctggggaacaggaaggaaactccatctcaaataagtaaataaataaatagcacagaggttaaataactctcctacactcacacactccatgtgtctctggtgatcacttggtaccacttcttttcttgcatgtctcacctctcttataaacacattaccaattttaaatgggtgttatgaactatgtgtattaattatggctgagaaccaccatttttaataacatggaattttctttagctggcagggaaggaatgcttccagtttaaaaaaaacggtaaaggacatagctttaaacagaaaagacgctttgaagataagttcatgtccataaagtccattcaaataacttagtaaattgctgataaggtcatatcatgtagcattttttaaaaataagattgctgaaagttcagcttgctctgagtaaacacagagcaagatgattctcaattatatagtgaataaaatcaataagaacatctagtgaaatccaaacagaaaataaaaaaatcaaaattgacttttaaaaaaattgacattttatggagataattgtagatacatatacagttaataagaaataatacggatatcctatgtacactttaccattttttccctaaagttaatattttgcaaaactataatataatatcacagccagaatattgacattactacaattcagcaattttattcagtttctctcggtgttcctatatgtgtgtgtgtgtgtgtgtgtgtgtgtgtgtgtgtgtgtgtgtgtgtatttagttctgtacagtttcatcacatgtgcaggtgtaggggaattggatatcacctccaatcccccttttagttcttagtaggctcttcagttggatctagaaaccaaatcgacatcaggcagaaaacaaaagaaaagaatacaaattgtattacttatacatgtacgtggagatcatcacaagaaagtgaagcctgaagaagtagtcaaagcaagatgcttttaatgatgaatgatgaatttgatgaatttggaaagcaatgacaggataaagagaatctggctagggacagtaaattttctctaggggagtcactaggagatagatagtgggtataaaactagtgaaagataagggttacttcagtaaatatatttattcaggtccattgaagcctccaattctaagtctctggtaataagggctattttctcactctggtcctgtgagggtgcccctcccagaggaatctttatggtttgctgcatgtaggaagagacaggtgagctaactctttctgaaactacaatttctccaaagtttccaactgaaaatagccaacataccaatctggcatatttggggatggaacatcctttactccttcacaggtatctgtggatgagagctgaagcaggcccaccaggaacagagagtgtttccccttactgttggcaattctctggattgcatctacccatcctgtcctagaaagtgtcaggagaacctgatgttgtctcagggaatcctcttagatgtggagagataagcctttctaggctgctttcgactgctggttgtgggtctcgaaatggtgagtctgggtcacttgcttctattaagtgaaaagatgtaagtcactcaacttctgctccagacccagtaaaccaaaactccgtcgtcttcttctgactaccttcagagttatcttgggtttattcctgcattattaccagcatttgttgctgttttagtgggaagaggaagggaaaaatgggtcgaagttatcttacccttaccagaagttcctaaatagactttttcatgagaaagaatatttttaaaaaactgtttatattataaatattcttggtagtttttttgctgttacatattttttaaaaatccatagtgcagatataataaaaactattgcaggtatttaaattaacagaactagttgaattcctacaacgtgtcatgtacagtgctaggttggttgatctgtctgtgcttctgctttacttggaatggatgagcaaaggcttatactaatttgcacttagtattataatgaggtgtgagaaaccaattttcatattcaagtgtctataaaaagtgactatttttcaacagttagctcctttaattataaaatcagtttttattaaaggcagttgatgctttgtgtgttgttgctagggtgacatatattatagaaacatacagtttatctttccagtaagagggaatacagtctctatcttaccgttaatactttaattagagaatgatcgacagaaaaatcttttttctcttcatgagatttgaaaaatgcatatcttctttatctgcatttaatcaaccctgggttcattaggatttgttgtgttggcacctgagaacatcttagaaattattaaataattcattttctgctttttttctttattttttatttccagcagaggcttgtattaaggagattctcttttgacatacccccacatacattcacactaatatatatgcactattttcaactgacatgttttagagttattgagatattaattttataggatactatcacattttatagctcttagtaaatagtatggtatttcaaaacataatttagttatagtaatagaaataatccatcatatttgttgtatttataaaatgtcttcaaaaatatcatataaatgatatctgaaattttgtcctagtcttgcaaatgctaggggattaatattaataaggttgttgtcaatataaatttctagtgagatgctcattaactggaaatccagtgctagagagacatttcagaatacctaaaccttatttagagacaaataaacatactagttaatatggctattgctatgaaccgcataaaattgaaatttgcccgaactcattcagctaagcatgctaacctcggctttggaaaagattgaatggcctatcatcagtcaatcttggtactagagttaaaagaagaggcaagtaatatggacagcacaaggaaaatgacagaaatagcggcttgtgatgataattagcaagaagtttgaataagcaaactctaaagaatattgaaaatgagacaaaaactgttaatgtatatgcaattaaatctttggaccctccttgcttgttgtttcaaatatccaattgtggagagaactacgctagggtaataatattgcccgttttccctgtccctccatgtactccaattaagaaagcagaaatgaaccatctaccctgatttttggaggaggaattgagtaggtatggcttcatgctctttaaattggggttaagcccccatgatataaattatatagggaatgcttcttcttccatttaatgcttactaatggatgtcactaggcaaattattagcaaacatacataataagaagacttaatgctatgttcgctgataacagctttatcattagtaaaggagatattttcatctctattcgtctgactcctatatgtgcggcttaattgattacgaacctaggtggggaatagatttaataattttctcaaactccatctataagtaatatgaagacatgataaatttttaagcagaaaaatgaaatgaaaaatattatgattcggaaaatttgtttccttgtactatgaaggatacttgggagcaggttggagaagagggtgaaggaaccgtttgggggacgcgtcagtaaaactggtggtagagactaggctgaaggatgatagtgggaatggaaaagtgaagacatttgaagggaagaagacattgtgtcggagttctaacgatgttcatttgtgcataaaacttgcatttgtctatcttattgtactttatatattcttcctaataccctgtactccattttactcctttttttttttttttttttttttttgagacagagtctggctctgtcgcccaagcaggagtggtgcagtggcgcgatctcggttcactgcaacctccgcctcctgggttcaagcattcctcgcgcctcagcctcccgagtagctgggattacaggcgcctgctactacaccagcctaatttttctgtttttagtagagacggagtttcaccacgttggccaggctggtctcaaactcctgacctcaagtgatctgcccgcctcggcctcccaaagtgctgggattacaggcgtgaaccacctcgcctggcccctgtaccccattttcaatatggcaaatggaataaatgtttttacaacatttatttgactgttgtttataactcttcaatagctgtccattactgtaaagtttatgccacaacctatagggctctaccttttaacagctatctctttctgattttccacttctctccaacctccctccctaaattacggtgatactgattttcttttaaaatacaggactactatcagcctcctttttcatcttttaggccacaacttaatgtttcttcctcagagaaatttctaaaggacccaaacccacaatagcttctatatgagactacttctcccattatatatcttccaggtatcctgtaatctcctttacaacagccagcagaattgaagtacactatttgtcaaccaaaggtgtgaagcttcttcttactcctggtgtttgtggttttattgactcttctttgttttctttaccagtgagatcccatctacatctttcagtattttcaccagtatcttggtcttttgcttgcttgctttcttgttttctaggttgattataattttattcctctaaacacatgaataccttccgtcattccaatggaattttggacaaaagggaaaaagttataagtgccaatttggttgccatgaaccaaaacagaaaattaaatacaattgcctagataatcaggcccaatttgtattacctagtatgaaaaacactttggtaacaacagtaggtcatgttaaactaattaatttctaggaacattgataaattaaacattggttactctccagagtaactctaagcccagaaaataagtgacttgtacatccatcatctgattcaggttcaaagagagtttctttattttggcaaagccaactttactgaaatgagatgagaagatttctgttgccaatttataatggagattaaaaataagaccccattgtcagagttggagatcatatgttggtaattgtggttttgtacaaaattaagaattgatccctaagaacttgtaaattataaagactttgtttagctcagtcacatttgcctaatctaagatttctgtctaggagaaataattttctagatggagtcaactagtacacctagtttaagtcttctttatgtgagattgtgtttaaaacagtgactcttttggccatagttacaatgagttcttcaagggttgtgtatttgcagactatcagtggaaagcacttgaatggcaatagttggaaattttgaagcaaaggaaataaaattgttacttgaaaccttgtaaaaagatcatacggccgggcgcagtgtctcatgcctgtaatcccagcactttgggaggcccagacaggtggatcatttgaggtcaggagttggagaccaacctggccaacatggtgaaacccgtctctactaaaaatataaaaattagttcagtgtaatggcgcacgcctgtaatcccagctactcaggaggctgaggtgggggaatcacttgagcctgggaggcggaggttgcatcgagccgagattgcaccactgcactccaatctgggtgagagagtgagaccctgtctcaaaaaaaaagataaatttttaaaaatccatgcaaagagcttgctattttgctattttagggagggagcatgagcttcatactcacttggaatttcctgagataaaggcagaaatagaattggaaaatatttaatataaatctgaaaagataaggcatttctcttagaagaagtttctaagcaaggcagctatatagcaaagggtgaggtatatatccctggctgcctcttagcacagggaactggcaccacggggcctacactggcccaagagttcttcaaagataattgtgttcccacaacttttctctgtgtagtaaactcttcctgccctgtagcagtccgcccagttcatgaaaaccatgggatttgacccactgaagaagacttttctcttaaagtttttcctgtttatccaggttttacccagtaaaggtcagctataactggtaatagttttgtcaatgtttccataccttgggacaaagttccttatttgctcggtatttcctctcaagttttacttggcattttgaaatttgaaaaaaattctatgtttttcctggctgtgaaaatgtattttttctttagtatttgatattcaatttataaaataagacttaaagcagctagatatttgcccatcgttatgtttagtggaatgaagaactaatcagctactactagtcttgttccaattaacattctattcctccatttccttcccacactgatatatgtacatatatagatatcagtgtgatatatatatatatcacacatacatatgctcatatatacatatatatcttatataagtctttgacctttctaagggtcaaacaccatgtttttcacaatctaggcaagctgctacaaggaaggaagagtctattatacacagaaaagctgcaggagcacaattatctttgacaatacaccttatattggtattttattttttttctgaaattactctgggttgagtcttatatttagtttctaattgtgaaggaaagccctgtaatgacctggtgatccatcttctttagaaccaagtcggccacagtcctaaaataaacatctgaaggcataggaacatttacagatgaaaatcataatttaatcaattgggtgtattatcttattttctaaatatgtatacattatttctttttttcttttttgtgagatggagtcttgctctgtcactcaggctggagtgcagtggcatgatctcggctcaatgcaacctccgcctcctgggttcaagcgattctcctgtctcaacctcctgagcagctgggactataggggtgtgccaccatgcccggttaatttttgtatttttattgtaacagtggagatggggttttgccacgttggccaggctggtctcaaactcctgacctcaagcgatccgccccaccttggactcccaatgtgttgggattacaggtgtgagccaccacgccaggctaccgtgtttcttttaaaaactttttttcttctatgtaccgtataggttttaaccctgtaagactgaacaccctcttttgtaagacatattttgtaatactcccattactatcctcaaagagaatttaccaaaaatgtaacttacatatatatataaaattctaaaacaattaccttgtaaaaaataaatcaaaggacaataatgaattaaaaataatggatatatttatcatcaataattaattattcaatatgaaaataagaaaggtacatactgctctagataaatgtagtacctgtacctaaaaccacagaagtagacagctcgaaatgctgacgtatgcaggtgagtggtatgaatgattaaaatgccatgaacagcatattttaaagtaatgggatttttctgtatgattaataacatttggtaaagttctgaataaaataagtgcacattttccctttgatttattgtgggatagtttcattcttggaaaatgcagtgcatataaagactttgtatttatatgtaaaattgagctaggttctatatattcacatacttataaacaggctgtcccctacttttcaaaagctgaataggacatgaaacaattactcattttcctggactttcctgcgtgttactggatgtctggcgtccttagagcacctttccatccgttatggggacaatcacagtgctttcacgtttcttaaatgtacccagggtatggtggtgtgcccagttgagaggaactgcaagtgagggttgtatttttttttttttgagacgagtctcgttctattaccaaagctggagtgcagaggcgcgatctcaattcactgcaacctccgcctcccagcttcaagcgattctcctgcctcagcctcccgagtagctgggattacaggcttgcgccaccacacccagctaatttttgtatttttagtagagatggggtttcaccatgttggccagactggtcacaaacttctgacctcaaatgatccacctacctcggcctcccaaagtgctaggattacaagcatgagccaccgtgccaggccagggattgcatttttgcatcgaagtagcagaaactagaaccagaggattttaactttctcatatgatggaatctgaaggaatggagtctaaagcaagaaactggccctgtgatggcatgaaaatcccaggcccctttgatcttcttgctcttttacaccttactatcattctcatgcttgtcaactcttggttgcaagatgatggtttcaacatctccagcctcaagtcttacatttcagagcagaaagatgaaaaaggaagcaagaagaaggaagaggcagcatgtacatcaggaaaacaaaactatcccagaaatccctagctgtcgtcctctcagatgccaaaaggccatgactgggtgccagagatgcttgaaatagagctctttgttcttgcttgacaccttgctacttctaaacaaaatcacgattttgttgttgagagaaaaaggactcctccctatctacttgtcctgagactgcttcagcctctcagcttcctagaccctcatgcagttgatttccaattcttccaggagctggcttactgtctactttttcagggtttcaaaaaaaaaaaaaaaaaaaaaaagcattttttaaagtttaaaaagcaaaatgtggagtgaatattttttggttactatgctttttaaatttttagaatttgtttttactgtgggttggctgttaatagtccatcaagacaactatttctttgctgggtttattggatattgggcaagcaaacaagcaaatagcagtatctgccactggatgtaatcaggaagaaattttcagaaaaaaaaaatgatgcttcaaggtctagataagcagattttccactggttcctgattattctaaataaaatgtttagtcagtggttgtgtaagtttcaaggatgttatagatggctcttgaaaacaataacacattaacctaatattttcagtactcctttttctagcttcatttatcctctcccatgcctgtaaacatgttactttgttaaccaaataaagtcattaatacatgagaccattttgccaaaagtaaacttaaaattaggaggaattggtctttcagaaggcaagaagagaccaagatgaaaggaagtcatttttgtgaaccatatgttttgacccagaagaactatttcacagcctttctcctggtagcaaacaatgagggaaacagtttcttaccatctgcacaataaaacttgttgaatcactcgggaattgggattattgctactgtttgtttgttgttaagccttaaatttaaaaaaagacaggatatataagcagggttggttctaatactgaaataaaacaaaaatgaacaaacccagagaaatctgcttccaaaaagccacagcacaacaaaaagaggtgtaaacatcagaagacctcaagggaaaaatacgtttatttagaaatgggatatcctggggattttgttacagcagctttattaagatattattcacatactgtaaaattcactctctagaagtgtacaattcagtgttttttcagtatgttcacagagctatgcaactatcatcactatctagttgcagaatactttcatcatccccaaaagaaactgtatgcccattagcagtcactccccattcctctctccctctagcctctggcaaccgctactctgtgttgtgtctctatagatctgcctattttggacatttcatataaatggaatcatactatatgtggcctctagtgtctgtaatctttcattttgcataatgtttttaaggtccattcatattgtagaatgtatcagtctttcattccttttatttgctaaataaaatttcattgtatggatataccaaattttgtttgtccatttatcaccagtttacgggtattcgtaaggcttttttttcccactttttgcttccagtagactttttgtatgtcacaaatggccatatgtttctttatcccataatcagaataaaaattatcattcttttagtggacgtgcctttttttaatcaaggcacagaaataaaaaagtgagttgtattttctcattaagaaaacattttggggtgtgcatgttttcagttgtttggaaatatgtagacatattggcagggtatcccacttacttttgctgtgtataaaatcaccctgatacttagcagtttaaaacaattactttattatgccgtggatgctgtgagtaataaattcagataggacacagcagggatgttctgtttatgctctgcaatatctatagcctcatctgtcaagacttgaaagctaagttggactcaatggctggagggtggaattctgaaggcctacatgtgaacttgctatgttgtttggcttcttcctagcatggtggctttacgatactcacacattttctatggtaactcagggttccaagcaaacgctgttctagcaaacaaggtagtagtcatatggtcttttatgaccctgccatggagggcacaaaacattactcttgccatcctctatctgttgaagtagttacaaactcacccagattgaagaggaaaggacatagaccctacctttccatttgccaatgagttttgggaccatattttaaaaccattgtgccataaagggcatgttttatgacaggtgaagctttacgtcttaaaagtatataattacaaatgattaaatttaaaatcacgagaataaaccattgcattcatctaccatcttgccactaaatcagaatcagtaaaacaaggtcaaattgactagaagccacatatagttgacatttggaagaatttgacagaaatatggctcaattggagttactgaatttaaaccaaaacgtttggcaccaagaatcatgggagcccagactaaagaggaaacatacattatatagctcttattatctaatggtgaaaatcctatcaaatctccacaaaggtggtgaactctggtcttccatggcatcctagacaaactttatttacaggcatgtatggtatataaaataggcatagataataaatataataatccagaacaatgataaaacagctactatgtcaaggtaccatcctaacctcacttataatcaggcattaaattctcataagaatcctatgaattagacaccattattatccatatttaacatatggaaagaaactaaagtacggagatgctaatgaacttacccatcgtcccactaataaatgttaaagtcaggatttgaacctagatgctcaggctccaaagcctatgctcaaaactcttgctatgtgaatactggcatattactgaataaaatagccccagttttgtttttaaataaaaaatgttgatcaatttttttcaataaaatattgtttcatcacaataagacctacttattttcctcctgagcagtttttagtgacatcaataacaatttttttaggctgggcacagtggctcatgcctgtaatcccagcactttaggaggccaaggtgggcagatcacttgagctcaggagtttgaggcaagccagggtaacatggcaaaacctcacctctataaaaaaaatacaaaaattaacagagcgtcgtggtgcatgcctgtattcccagctacttgggaggctgaggtaggaggatctcttgagcccgggaggtcaaggctgcagtgagccatcattgcaccatcgcactccagcctgggctacagagcaagaccctatcttaaaaaaaaccaaaaaaattataagcgagtcatacaagttcttcacagcttttcattatggtaaaccttgattaaaagccaaggttataaatgtaatttttgctaagtgcggatgtattgtatctgtagcaaactgtaattcaggcccctgaatgtaacatcctagctctcattccttttgctgtcagatttccctatagataacgtctacatctgctaccttatctactcgcaaatatttatgattttcttccatgaaatttacttttctcccctgaacctgtaagccaaatcaagtgaccttttgtgaatctcaaacctctgtgaattttaggtagatttaatattcttggccaccactttctattcagtcaaattcaagaattctataaagttaaatatatatggatgtgtgcacacatatatatatatgtgtgtgtctctaggtcatgaatcttttaatactatagaacatagaacatagaaaattataagagaaattaaaatatattgtcaatttaaaagcataccgaaaacatgttatatgagaatggaataatacaaattattggtatggggagaagaatcatgaatagtttcatgaggaatgtggcatgtgtaacaggcattaaatatgattaagaactaacactgagtatatacaagttagctgtatcaataaaaatgtaaatcattcagcaataaactataaagttatttttactccataagggtttttttccctgaaattttcggcccaaagtgactgttttttcttcacatgccacttatatagtgtgaccaagtatttagttaaaaaaattattctccagtcaaatcatttgttgtacacttcttggagctgtggcttgcttgtgtttttattgattaaaaaatacagcacaatcttgcacctaataaaaacctaacaaactggctgagtgcggtggctcacgcttgtaatcccagcactttgggaggccaaggcaagcggatgactggaagtcaagagttcaagaccagcctggccaacatggtgaaaccccatctctactaaaaatacaaaaattagcctgacctggtggcaggcatctgtaatcccagctactcaggaggctgaggcaggagaatcacttgaacccgggaggcagaggttgccatgagccgaaattgcgccactgcactccagcctgggcaacaagagtgaacctctgtctcaaaaaggaaaaaacaacaacaataacagaagaaacccagtaaataataggaaaaaagtgaatatagaaaagtaatagaaaatggttgcctttgtgaggttagatgtaaccaaaatattttagcaattgtttagaacaaatagattaaatgaaaaatatttccattaatattttaaactgttaaattctgtctaatttcacatggtagatacacattcattaagacttttcagtgttaagactaaataaagaaaaagaaaattcttcttattgtgccttattcagaatccactgaatttcgttattatttttattatcattatcattatcattatcagtattatttgagatggagtctcgctctgtcacccaggctggagtgcagtggcgccatcttggctcactgcaacctccgcctcccgggttcaagcgattctcctgcctcagcctcctggggagctaggattacaggtgtgcgccaccatgtccagctaatttttgtatttttagtatcttatttttgtgggtacacaatagatatatatatttatggggtacatgagatgttttgatacagacatgcaatgtgaaataatcacatcatggagaatgggatatacacccctcaagcatttatccttcatgttacaagcaatccaattacactcttttagttatttttaaatttacaattaagttattattgactatacttaccctgttgtgctatcaaataggtcttattctttagcaaagcatatttgtaaagagtttggagtttctctttgctttacacactgtaaaaaaaaatgtcaaacaaggttatccaaagagtagtaggagaatgagcattgagatcataagtgtctcatctgatcaaagttattcaagaatgaatgcattttggaggcaagagttgaggaccatcgccatcattgactatggagtaacacaagcccagactcttgagattaatttggcattatctttcaaaattaaaagtataattacatatttacatagcaattctacttcaaggagtttgcccttcatttatgttttcacatgagtaagggtttagatggacatgggttttctttgtagctaggtaatagtaaaataggtaatctaaatggacatagcttggtggtagtccatgcctgtgccctttatactacagttttaaacaagagatgaatttatataaacagatgttgaaatgtgatcgttatgtagtattaattgcacaaaagtagaacatatatatgtgcatatgtatgcatacatacatgtacatacatatgtgcatatgtgttctagtttattatatatatgtcaaattgttctatttgtatgaaaacactataaatacatacataataaataaacaaatatgcgtttgtgccaaaaagcacagaacatttctgtttagtctcataccactcattttatagctttatagataggaagaaggtagactttgatggtacttgaatttttatctatgtatctgggcaagtattttatctatgtatgtggtagcatattttatctatgtatgtggtacatacatgttttatgtatatgtatgtatacatgcatatatgtatgtataaaatacatacatattttatctatgtatgtggtagcacgtgagagaatttttgttaatttatatgttatttcacttcaaaaattgataaactgtgtgtgtgtacatatatgggtggtggctatatacatatagatattatatttctgggtggtttataaagagcagaaatgtgttgctcctagttctagaggctggtgagtccaaaagtcaccagcatgttaggtgtcttgtgagcccgcttcctcagtgacgttcatcttgttgatgattcctcacatggtggaggggaaagggagcgttctaggttctttttttttttttttttttttttttttttgagacagaatctcattctgtctcccaggctggagggcagtggcacgatcttggctcactgcaacctctgcctccgggtttcaagcaattctctgcctcagcctcccaagtagctgggattataggcacccaccaccacgcctggctaattttttgtatttttagtagaggtggggtttcaccattttggccaggctggtcttgaactcctgacctcgtgatccacccaccctggcctcccaaagtgctgggattacaggtgtgagccaccgcgcctggcctgtaggttctcttttacgaggcaactaattccaataatgagagctccatcctcgtgacctaatcacctcccaaaaagccccaaacccatctcctaatactatcactttgggagttaggatttcaacatatgaattttgggtggacacaaacattcattcaataacagtgactatactatcctatgttaacattttactattttcaaagcttttgttcactttgtatatatgcatttatttatctttgtagcaaatgaaggataaaaatatcttttggagtattatcttgacatactctccagctgctagggatgacctgtcagtattgaccccttgggctgaagcaattcgatcctctcaaaactcaaattgaagtgagaactatctcttctcctttatttcctttcaccagaaatagctatttcatgttttaaaacaactggaaggtaactgaaaactttcagtggtgttaaatcactgtcagaaaaaaaaaaaaaatctgtttgaaagttggaaacagctcaagtaaagccatttaatctgaccagcataagcagattctgaagaaaatggtgaagaatatcattagcagcaatgcacacagtcatttattcattcaacagatgaacatttgatgaacacttactggttcttggggactatactccatgcctaaaatacaaagatgaacgaagacccaattcttgctctcaagaaaatgatagtctgttaagaagaatttactggaagatagataagtataatactgaaaagtgtgaagaatgaaacaataagatgtgcaaagtacagtgctgtcacaaaagagagagaaataaaagctaactggacaggtcagaagaggcttcacatggcactgtcttgaagaatgcatagaaatattctacaaccagcaacttccaattcagttgaactatctccatgcttcctgttcaaccgagattacattttcaatcttgtttctaaaggaaggaaaaaaagatgagtcatttggtacaaaaaagcaagaacagctatagtctacactataagataaatgtagggtactctttaaatctagtggacgctgtccgtaccctttcagcgctcccattttgtctcatcatctaattgcgtgcacctgaagactttctctgatgggtttgccactgcggggaaggctagaagtgctggaatattgaagacccaagcagcattcttcaggttaataatagatgagaattggatgataaaaactctaaactttttacactcaaataggatgcatgaggcatgtctatttcatttgctagaagtctccagtggcattaagtcccagtcatccatagtcataacttgctcattaatgtactctgtgtgttcctttcttctctatctcacttctctacttcctgttgatgctttctgtgatctccatcacagatcttcctgtttctcacttcctgttgatgctttctgtgatctccatcataatcagctacatggactcaaatttgtcatttaagtctgatcttggggaatccaattttagacattgagcaatggactggctgggagggatgaaagaggagacaaaggggctcctatgttcctggttcaggaaacggatgaataacatcaccagttagtgaataggcactgcctttcagtacctacgggagtgctttgttcagtacatatcctgcccagccaagcactgaagaattcatgaattttattgtaacctaaactgcctgtggcattatgaacctgtgtaatcatgggtagtgttggctttataccaggattttgctagcttgttagcatctccatgtgcatttgcaagaccttggccactcttcagtgttttctactccaatttgcatcattgtccctgcaggatgtttatcactcagacattctgaaatttggactgatgcttgacttagctctgtgattggatgcttctcccagaacctttctcacctctatcagctacgctaatgataatctagacagaggtttccctccacgggtgctgcagctcaaactgtgccctagaccactgtcagtcaacctcttcaatgccactgtttggtgctttgcttggttctttcagtctgcatgaagtcgcagctactcaacttacatccatgaagcagcaaggggaaacttcccattctcagtgttttaatctgttctctgttataaaggaggcatagtagagttgctggaccccaaagagtgacttgtaataaaataattctttaaaatgtatacatagatcttgtatcccagggcacacatttgacatgaaaatggctgttttggttgtaagtgcaggtaacagccatcaaggtgtacttgggactcctcctccactccaaatcttaggcctcattattatttagtttatcctgtctgtatctgcaagatgatttttacgtgagaacactagacttaccccttgacactgtgctttttgcagctcctcatatttgatgggcatgaaagctaatatgttgtctaattatggagagttttaagttattaattttatttttatcaggagatccttaaccccctatacaaattagatctaaatagatactaaaagatgaagttaatatttaactcctttacccaccagatgtagctgaatctttgcattggacaagtgagaatcctacttactctgaatcttagatactttgctttgagtatgattcaatgtcactgttgctacagaagtataaatgatggttatttatgcttgcatgttttccagaaagttaaagactattttattatattggctttctgattacttgactgaagttcataaactaacaaataaaaatctaaaaacactctctggggacctagacaaactataatgattaaagcatatagttactttgaagccaagatgaggtaaaggggataacttaagacatatttattcttaggctgacatatcttgtcattattatgttacaggtgcacatggaccatttattttttctcttatgaagaatttcaaacatatacaaaataaaaaagtaacataatgcataccatacactgctcattagctctaaccattattatcattaccatctggtttcctctctacctacccacttcctattctctgttttgaggcaaatccccgaaagtatatcacttctactctaaacatttcagactgtattcccaagtaacccccccaccccacttcttttttttttttttttgagacagagtctcgctctgtcacccaggctggagtgcagtggcacgatcttggctcactgcaacctccgcctcccaggttcaaatgattctcctgcctcagcctcccgagtagctgctactacaggcatgcgccaccacacccggataatttttttgtatttttagtacagatgggatttcaccatgttggtcaggctggtcttgaactcctgacctcaaatgatccgcccaccttggcccctcaaagtgctgagattacaggcgtgagccaccgcacccagccccggaaaatatttgcttaatatcatcaaatacattttatatttcccaaattatcctataggactcctctcttctctctgttgtctctgtttcctccacaccctacatcctcctcctccctcatcctcgttctcactctcccttttcatttttgaagaaacaggaccttttgtctaggtttgttgattacatccacatgatattgtttaatgtgtttcaccagctcctgtggtgctgacaaattagcagctaagtctagagagctacttgtagtcagtttgattttgttctttttttactcaagatgattgtatagaaagtgttgtgtactttcaacaaaaggtatataacgtttgatattggcagccattgatgatcattgttttgattgattatttcattatgagttgcaaaacaatgatatactgtttttacttcttcatttgttaggaggagcagttctataaagagaactttttgttttgttttgattttttgtttttgagacagagtcttgctctgtcacccaggctggagtgcagtggcataatctcggctcactgcaacctctgcctcccaggttcaagcaattctcctgcctcagcctccctagtagctgggattacaggcgcacgccaccacgcccggctaatttttgtatttttagtagagatgggattctgccatgttggccaggctggtctcaaactcctgacctcaggtgatccacccacctttgctttccaaagtgctgggattacaggtgtgagtcactgagcccggcttataaagagaactctgcatttctatttggttgcctcatagtataattgatacaaagcaaagcagagtaaatgcttcagtttttcccccaaaagaacaattttcaaaataatgaattgcttctctagtctcttccaaaagttgccagtgaattttttttttttttttttttgagatggagtcttgctctgtcaccaggctggagtgcagcagcgtgatcttggctcacttgcaacctccacctctcaggttcaagggattctcctgcctcatcctcccgaatagctgggactacagacgcgcaccaccacgcccagctaatttttgtatttttagtagagacggggtttcaccatgatgttggccaggacggtctcgatctcttgacctcgtgatctgcccacctcagcctcccaaagtgctgggattacaggcgtgagccaccgcacccgaccaccagtgaatattttatttatttattatcatccagttgtttgttttggcatcactgcgaatgcatgaatttaaatatatttaaatgtaactgaggctctccaccttctgtattatgatctttattgtcctcatatttttcatctttatgcgatggaagcctcctttacattgacctcctgagtcctttctgtatgacctttatacactttggttgaccccaacttctcttgtagatcaccagtgggcattcctgaggtgtgggtataacatttatctctggattatttattcattcagaaactttacttagtaattaacatttactaggcgttaacaaggaagcagtaaagcagcaaacatgctcatttcaatatttggattaatacaatcaatcaaaacagtagttattgacaacttacttattgtgtggttagcacactcaaaatttatgcagagaaaaaagatgagagattagacctcctccttactgtaacacattttcaatctgaccagagattttgcttctgcaaatttggatgcctagcattggcatcatcaagactttcatagctatggaaccatcagatataaaatacaccttagtatgcaacctcaacgtgttcttcctcttgcaattgaggttatattaatttattaagttcattttgggataaagaagacagaatcatagttctttcagcctgttattataacactttattatcctttacctccttccaatttttgtgtctaataattcgtgtgcatgtgaactgtcttcacttttgagttttattatgaaactcaaactacaatacacatgtatgcataaatttctgtatatgtggcatgcgtgtatatgtgtgtatgtatgtgaatatataaatttcgttgaatagagtggtatgattgtctttggcctccttaattatatatattagcatatgttctagggctcctgacgcttcttgcaggcagaaggcatttccagaggttgtgtagatccatgaaggacagttatcgggtcacatctcacatcatcactgtttctttcttgcccctgtcttacactagtacccttcagggtattgtatgaaagcttcattggttcaaattcattttgtcctctagtgctactttctatgctgacaaaagcatagtgaaactgatgccctggcttgtactgcagtaatattgcctccaagcatatcaagtacaggaagttaaatcctatatattattaagccagatcagtaacatgtacccaacaatgtggtgagacatattttgttttaataaaacgatgatgttacaaattcttcaaccttcccatatgtgtggaggtgtgtgtgaatgtctgtattaatctaccccatgtctcctggatagagtttttctacaaagaaccaagctcagcttcccctagtgttaagacattttgcttcatgcttggtatagtgtagtgctactcaaacctgagtaataaacaggccagtttaaagaaataaaaagccctatgctcaaccaatgctgattaaaattatttttattaaaatttacctatagaagcacgaatataaaacaaagggcacactctttatggtgaaagggcatatagatctacaacaacaaatcatattttcaaatcaaataaaacagaagtacagaaaagcaatagaactcaaaagcataaccttaatgtgtctgccaatgttgtcttggatacattaaatggccttttataatgtgaatatagtactagctgcaatggtgcaagttattgtatttttagcatttttcaatatatgttgtgaagactattttactgcttttctctattcagatctttgcaaaaaaactcatgtatacactataatcatgttttttgccattttgtagtcctatgcttttgtgtcatcagccttccccagctagaaaagtataatattctattattgtatgctgttgtcattttcccacaatcaaaagtacaaattattaaggaaactgaagtttcggtctaaaatgtgttgttcagatgaaattatccataagaaattaaagttgtgttcttataactggaaaaagaacttaacgcaagtataatatgtgcaaaactgggatgacttagttcttgctatcattaagaggggacaaatggcaacgagacgagctttaacagctgagaaaatcttatgcctagatgtacataggcctggaaattacatagcagtaaaactgtaccttcaaatagctcaaaagcagctcataataactgcttgagattatctcagtgataaagtcagtataacatagtgttttttattttaaaaaggaaaaatgattactttctttacagtatgctaattaaaatatacaggtgattgaaaaaactattaataaaaatcagtaattttgttgagtgggattatgaatattaattatttaattaaaatttccttcaatagttaacaaagatttattgagtttctgagtcaagcattcttctaaaggctctgccttattagaatttttaaatgtatttgcaatgagtgtatattaaatgtaaaatgtatgattcaggtttaaaaaaaaatagcagtgagagtaattgaatgctgaggttaaatagaatgggtgaatcaaccataccataaaaaacttctaagtggatattatattccaggcactctttcctacttcagctgttgataaaatcaaatatttccttagagacccttgactaatgcaggaaataaatgaatacttgcctatatagacaaaataataacaacaaaagccagaaaccaagccataccaaaacgaaacaaaaacagaaaaactgtgatgacataacttatctttcaataggattttctcagaatgggaggcaatatatattttatgcttccatggtctgtagattccaacatttgtataattaacatatacaattttacaagggaaaaatactattcaacaaatacgtaaatacgttcaatgtaatcatgcagtacttcgtttaaattgaccttttttttttttttttttttttacaaatggtgcaataaaataatcatgtttaccttcttcacatgttcattgatgttggcgtgcacggttttatctatatgatgtgaccttttgagaccacatgacattcacaaactgaaactaaaccaactaaataaccagttatccaaagataagcaaaagtggacgtcagtttaattagtaaggggagattttaatcagtaatacactattataatagagaagagttcagcatgaactgaactgaactttgatttgtgtagaggtgactgggagttttaaagggagaatgagagaatgagtttgagtggtggctcattaaagtcagggaagtaacaaattacaaaaagtggaaaggtgggattgttccctgggaaacctctacgtttgctaaatggcacttaaggttaggctcctgccttctcactgtcttcgggttttgactggaacaaagggtaaattattttggcagctttgagttttctcagaaatgcaccttaagtggggctagagttatcctagagaggtggctttgacctgttagaagctatgttagtgttttttgttcaggtctgtgcaggccaaggttatggcctagctgagaagagggctcagaggagcctagctaaagtttggtcaaggggagcgtcttggtggagcctcactcctgttcaagtaaagaagacacattattcatccttctgaacagtgtaagtccatttgtcattcgattgccttttgtttactaaggactagctaaatcatcggttgagacttgctagtagagcatagttgctggatgatgcacgtgatcaggcatttaatgagaggcacctctatggaaacaaacataaaaacaaaaacttgttggagaagaatataaatcctatttgttgagtctagagggcaggcagttaagaagttttctagacattgaattctaagcatcttcagatggtagagtggtaatctgatggattttctggtttatggtttgaatgtggtgatggcataaacattaatttcacagtcatagttatttcctggaacagaacacggatgatgctggagttccagtggactttctgaatggctcttgtagcaggagctccaggcatgaaggttgcctatacgtgatttgttgtggtggtaagtcttttgaagtttatatcaagttcttgggcttcagtgtgcaaggctttttcaaatcctgggggagaaagacagctacaagacaaccttgtaggttgtcccagtagaatcagtaggttgtaggagtcccagtaaggatttgggcagtcagattttaattctcagtgatgtcaagtcaagagggaaggcaaaaaattataaacatcaatttggagagatgtagcccgatattgaaggaaaactaaacaattgagtatttagtaagagtggcaaaatgggtgagatggcagaattcagtttagtttacaggtaaatgataaaatcctcaagacaatgaacaaaattggaatctgataacccacagtggtgtgttttacataaaacacaacaaaaccggaattggatgagaagagtccctggatctagggtcatcagaatgtagctattaagagttggattctgaagccaaattcaaattaggtgccttgtactttgcgcactgaatgctctcaggcaaattatttaccttctttgtgcctcagtctattcatttacaaaaggaatcttaagagtatatatctcataggattgttttgaaaattaatgagtacgttacattcaactgtgtctgccacattgctgtgaagttattaccttcctaatatacttacaaacttcataattaagaaaaaataaaaattcataaaatgaacatatttgtaataacttattataaatattgtatagttcattaaatgtattacctttagacatattaaaaataacacacccctcatccccccccaaaaaattcctgtatgcctgttttaaagcagttctgcatgttaaagctgcatttatgatatctaagaagtgttttttctcctaaatagcaggttggtaataatgtatattgcaatcgtaataatgtaagttctggttacaatagtttatctgggtaacatgtagaagttaagtgaatgaggtaataaattaaccaataagattacctttctggtagggaggaaaaacacttctgggttgaattaatattttgtacacatatgaaaggaagaagaaaaataagaaataccatttgcaaagctgactttaataaattttaattgaatggataaacattttagttaaaggtagtaatcttaacttgagattacttgagataaaaatatatattttcttaagagacatgattgttagataacttagagatataataagtggaagggttttccattaaggtaactgatagtccttaggtaaattaaataatgggaggaacttgtgttaggaaatcaacatccgagttacagttaaattggtgggagtctttccagtgcctgaagatacagagattttcaatagaaataaggtttttctgagaaattaagtgaaataaaatgtgcaatagtgattgataagcactgtttattgaagaaacgatttatctttattcttgccctttgctttttaaaacttttattgcattttcttctatttttaatacactttgttattgaagcataacataaccatataccataaacacagatagctaccactcagatcaccacttggatcaagaattaggaacgaacatatttgattttaactgcagtctcttctctcttacgctgaaaatctatgtttctaatgacattagtataattgcttatatggtaattaccttactatatacatataatggttccaaaataacagttcttgaattatttttataaaacaaaattaacacaaagatttatagtgatttctgcatttattttattattatatgtttacagacattggctaatgcttctgatgatcaggcttctctcgattaactgaagatagccttactctgcagctgtgtatttcttattccatctggagcctatgccatcagacattatgtctgccatattttttcttctgtggaaaatcagttttctttctgaagtgcttatttttacctttggctgctgatgtagatctttcatttgttcttcatcttaggctgtgccctggctctaaaaagtgttctcactgtctctttgctttcatttttttcctttcctatccctacgcccttaaatcacaatatctgtcagagttccagaagaaagaataaatactcaaaggagtcatgactattataatagttgatagtgtttactttggcctagttgtttctagatttgtctcaagaagcaaacaaaccaaggattatatatataccatcttgaccacaaaccaagcctcagattcctctatacatatgtcttaagttaccaatacatgttaactgttataatatttctttgactatatgtatacaccatgtagatgtagactatgtatactttgcatcctgctgtttatcacatgcctggcacatattaggcactgaaatagttgcttaatacatcaaaataaaattgaatagggaaaatataatttcttaagttagcattcccctctctccacccaaaagtattaaataaaaaaacaagagtttacgatgactttaacattatgatagagatacaagaaaaacaaataagtatagtaattgaaatggtgcccagaacaccctctttgttgacactaaaagtaagttcatcagaccaaatctgtactgttcagctctggggaacataatttaaatgagacactgaaaaactggagcctgtctagaaagcaacttataattttagggacgtattagctgttttcaaatattcagctaatcagtggaaatgcaatgaagcatattcttattatgatgagaagaaaggaaagagagccctttgtccactaaatatttaaacaaacaaactttgtaacagtgagagatggccaaaaatataaaaagcttaatctggaagtagtgagttgtttttcactggggtgtgggcaggggcttcatgtctatttaaggaatgctgtgttcccatggaaaaccagcacaagacaaggatgccctctcttaccattcctatttaacatagtattagaagtcctgaccagggaaatcaggcaagagaaagaaataaagcgcctccaactaggaagagaggaagtcaaactatctctgtttgcagacaacatgatgctatatctagaaaaccccatggtctcagcccaaaagcttcttgtgctgataaacaacttcagcaaagtctcaggatacaaaaccaatgtgccaaaatcactagcattcctatacaccaacaacagagagaaatctgttccattgcatctgttgcatgcagtgcaacagggagaaatcagtaatgcaatcacattcacaactgccatagaaagaataaaatacctaggaatacagctaactagaggggtgaaagatctctacgtggagaactaccaaacactcctcaaagaaatcagagatgacagaaacaaatggaaaaacattccatgttcatggataggaagaatcaatatcattaaaatggccacactgctcaacgcaatttattagattcaatgctattcctattaaactaccattgagattcttcagagaactagaagaaactattttaaagttcatatggaaccaataaaagagcccaagtagccaaggcaatcctaagcaatttattagagtcaatgctattcctattaaactaccattgagattcttcagagaactagaagaaactatttcaaagttcacatggaaccaaaaaaaagagcccaagtagccaaggcaatactaagcaaaaagagaaaagctggatgcatcacattacctgacttcaaactatactacagggctacagtggccaaaacagcatgatactggtacaagaacagacacatggatcaatggaacaaaacagagaaccaagaaataagactgcacacctagcaaccatctgatcttcaacaaagctgacaaaaacaagcaatggggaaaggactacctattcaataagtggtgctgggataactggctagccacatgcagaagatagaaactggaccccttccttacaccatgtacaaagattaactcaagatagattaaagacttaaatataaaacctcaaactataaaaaccctggaagacaacccgggcaataccatttaggacataggaacagacaaaggtttcatgacaaagatgccaaaagcaattgcaacaaaagcaaaaattgaaaaatggcatctaattaaactaaatagtttctgcacagcaaaggaaactatcaacagagtgagcagacaaactacagaatggaagaaaatgtttgcaaactatgcatccgacaaaggtctaaaatccagcatttataaggaacttaaacaaatctatgagaaaaaaaaaccctactaaaaaagtgggcaaagggcatgaacagacacttctcaaaagaagacatacatgcggccaacaagcatatgaaaaaagctcaacatcactaatcattagagaaatgcaaatcaaaaccacaatgaaataccatctcacaccagtcaggacggctattaataaaaagtcaaaaaatagtagatgctagcacggttgtggggaaaaaggagcacgtatacattgttggtgggactgtacattagttcaaccattgtggaagacagtgtggcaattcctcaaagacctacagacagaaataccatcaacccagcaatatcattactgcatttatacccaaaggaatataaatcgttctattacaaaggcacatgcacacgtatgttcattgcagcactattcacaatagcaaagacgtggaatcaacctaaatgcccaccaatgatagactggataaagcaaatgtggtacatatacaccatggtatactgcgtagccataagaaagaatgagaccatgtactttgcaggaacatggatggagttggaggccattatccttagcaaactaatacagtaacagaaaatcaaatactgtgtcttctcacttgcaggtgggagctaaatgatgaaaacacatggacacttagaggggaataacatacattgggacctgttggagggtggagggtgggaggagggagaggattaaaaaaaaataactgatggttagtaggcttatatctggatgacaaaataatctgtacaacaaatccccatgacataagtttacctatataacacacatgcacatgtacccctgaacttaaaagttaaaaacaaagaaaagctgtggataggtttggtggacaaactaggaactggagaatatatgggaattttacaatagtctcactggagccttagtgggttttagtagtgtttcaagggccatgtgtagggtgagaagacagtggatgcccaccaccaccactaccaccatcagcattcctttagctgaatagctcactcttcatctgtttcatattgggcttctgggtcacattctatttaaagaaagagtttccactcgactctgaggtccttgaatccaaagtatctctcataggtccttggagcaatcgtattggaatttttaaaatgttgattgaatggcttgaggtgaaaggaacctgttgcacagaactagttctctgttatgagtccacaaaggtcttaaattcgataaacattgtttttactagtaagtgtcttagtatcttaaaattatagtaagcttgattcttttctatcatgttggcacagttcagttagcaaataataaaatgaaacaatgatgatatgtaggtagacatattaacatgcctttgtatggagcaaacaataagaagcagatgggacagtctgaggaacgcattaacaagagtttctgaagccaactgctgctgcacctgttaacctggaaggagattaatgcagtagaacagctactgtctttccatatttcttaccacaaaaagatgttttattacattcattgtaacctcttggtaacacattcagaatacaagcttcttcctagtttccgcacatgtctttctcatgatagcatactgtctttgaaaattccatctgctttgatgatttgggctattctatcaaggcaatataaaattgtttttcttaaactttattacaggtcattgagtttcatgatctatagtgaatatttctgtattgatttgttggtatttttattttctcttctcaagctccttgtaagtggggactagcaatgtattttttaattttccgaactatttaaaatctttgatgccaatgattcaacttaaattctggttatatacaccaatgataatattttgtatctagccgatatttaatatttatcatttttttaaagaatcattcactttcatcactatcatagagatgggacaaaaaatataaagactattttacgtatgtatgacttgcttggtaattatttgctgaatgaatgaaaaatacaaaaattgatagttttgctcttacccatcttgtatatctcttccagtgctcattttgcattatgtattagttcatctttgcctttattaagagtagaaaacgccatttcatcttttacatataaaaatgagtctggtctgatacagttactcacatcttcgcttaaatttcttttcttcttcttttttttttttttttttggtggagtcttgctctgtcacccaggctggagtgcagtgacgcgatctctgctcactacaacctccatctcctgggttcaagtgattctcctgcctcagcctcccgagtagctgggattacaggcatgcaccaagccacccaactattttttgtatttttagtagagacggggcttcaccatgttggccaggctggtcttgaactcctgacctcaagtgatctgcccgtcttggccttccaaaatgctgtgattacaggtgtgagccaccgcacccagcccagtgaaatttcaatttgaatttggaagctctactaaggtagtaatgtgaactttcaatattattagaaagctcatcaatctgaaatttaacataaggtaaagaaataaaaagcattaagaccttacttcatatgagagctagaatccatgacctgaaaaataaagtagataaattcacttataaaactataatttaaactcttaacttgtaaatttggggaaattagtggtgaatgggtttctaatatatggaacatgaagcagtaggaaatatgttatgagttgtgacagatattccacctcccacgagactgtgatttttagaatcgacgtgttataaaattgatctgaactttgtccctgatgctggaaaagtggcaacctgtgactgctctaaagtaagctaaaggagctgaacaaggctgggcacagtggctcaggcctgtaatcccagcactttgggaagcagaggcgggcggatcatgaggtcaggagttcaagaccagcctgaccaacgcggtgaaatcccatctgtactaaaaatacaaaaattagccgggtgcagtggtacatgcttgtaatcccagctactcggggagctgaggcgggagaatcgcttgaacccaggaggcagaggttgcagtgaaccgcgattgtgccactgcactccagcctgggcgacagagtgagactgagtctcaaaaaaaaaaaacaaacaaaaaaagaagctgaacaaatgctggcattcatacatggtttgagaaatagccctttttcatttaagggaaagacttactgagatccagattgagaaaacaccccatcaacaataaagtggctcaggaaaatgttttatactagcacatcttcaagtttctacttaaggctattctacatgaatatttaaaaagaggagatgtcaaatataaaagcacaagaggccccgagggcttagtatctttatttgcgttaaggtttctcataaataattctatttggggatataggctctggtatatatgtaataaatgtgagtctttttaatatcagagttacccttaggatagtaagtgtatttatttcaaagaaatataaaaataaaatgaataaaatatttcaggtacctcagatcattgcaaattagtcctcaagtctctttcagtttttcttggattatatgaataatgctttgggatagaggaaactcaccaaagtatatttctgaggactgggggtgggaaaggtttcagaaaggagaaacccatgggaagaatttttctactgactgtcaagtaattcatctcaacagaagaaaagctgattttcgatcagtttaaggtaatagaatatgtcagaattcctggggttttctttgttcaatagcccacttaacctgctgcagaacaccctaggaataacaaatgaatcataaggtagagggacattccagcacacttgttttcttcaaatattgatattttccccttaaaattatatgtctagaaaagcttttgctcggacagagtctgtagggccagaaatataaataactgtcaaatataaagctgaatcgcctccacaagattttaggaacttctgggctggggaaatgtggcctgaaggaaggctgctggtttggccactctctgtattccatcagaaaaaatggtggggtataatcagaagttgaaatgctcacagtagttttaccccatggcttgtcagctgaatattgcgacaatataggaattcttcatcgcagaaggaatgagcctccctggactgatgattttctcagtttatggtgtgtgtgacgtttttgtaaagtggcaaatagttgggggcatgagctagaaggtaactttaggaggttcaaccaaccaagtaccacctgcgaattggacaaaattcaatggacaaaagaaaacttaattgtcagcttactcccgccttttactcccgggacctagcttatagcacatggttcataaaagactctataaatgattactgaatgaatgaataagtgaaagtgcacaaatgaatgtatctctgagattttaagacacttttgtgttcatgcgtcttgcctacctgtctccggtccttctgaattcataaaaagaagaaagttcattttttctggaatgactgatcttaggaaataggaataagtaattctgatgggtagaaagtgcagtgtatgaagattcagaagggtaaggccaattaatttaaacactctgagtctatgttctaacctgtaaagaaggctgataatatttgccttctctgctatggtgttcccgaattgtgctttccaagaaatataccatcacacaatatatggccgtggtgaatacagtctccaatgtccttctccccctgcaatgtgccaacagagtgatctccctaagcatacagggtggtgcagtgtaaaggcacactggtttctgtttgaattccagctttgctacttactacctccataatgtgtagcaagatacttcatcactcacctgtaaaatgatgataaaatgatacttatttctatgagaattaaatagctgatacaagtaaagagcttaaaacagtatttggcctgttttaagtgctcaatagatcctagatgttgtcattgctgttactactgctgctgctgctactactactactactacatatttgtttttggaccctacttaatcccataggttgccacaactactgtctacataatgaaatctaacccccaagtataggatactggtttctaaaaatctagttcatggctatagttctagcttcattcaccaccgttctactagcaataccagtccatctgtatttcctccaatagaccactctatttttttttttttttttgcctctgcacctttacactggatgtttattttgcctttagtcacatatccacaaagagatgttctgggctccatatgatggagttgcatacagtgctgagcttttctttcagggacatattcagaaaggatgagtttttgattgttgtcaaatttgctgttatgctgattttttttagaactgtttgggcgactaatacaaattcatccaaagcttgttaagaatacattgtaatcatcagtatttttaaaaagcgattcttcattctttaccattgtgtttcccatcccaaggatttcttcagattaaaatattaaatgggacaggcaacactttgaatgtaaaggagaaatgggaaacactaacacaatggtggcatgataggggatgaaacacagaaagttggaaccaaaggggagcaccatcgttcatatttatgtgtaaggaaaagaacagaatgtccttgggtagtttactatttcttaataattctcctcacttttaggcaagcttgccagtttttttcagtggggatcacaaatgcctatctgtctgtctgtctgtctgtctgtctatctatctatctatctatctatctatctatctatctatctatctatctacctacctacctacctatctaatctatctatcatctaatatattatgtgtgcgtgtgtgtgtgtgtgtgtgtgtgtgtgtgtgtgtgtgtgtatgtaacgatttaattgaagcaatggtaagacattacaacttcaaaaatactgttttacttcacatacactttacctctaggtttcatagcaagacaatagatgggtgtagttttagtattatttacttttatttgttaattcaaggcactatagaaatacttaatctgtttaaaccccaaacatctctttaaaatattttatgtgacgagcaaacagaacatcatgatctaataaaaatgaaaatgtttttgatgttaaatgttgaggtaaaacttttgttcagttattataaaataatgacattttgagaacctcttatttttaattttatcgtctctaaaattgagacaatcacatcttggtatcgataatttttgatgcatgatgtaatatttaaaggactttaaaaatgtaaaatgctgcataaatattattgctctgcttaacagtgtttcaaatacatttttggaaaaatagcaaagtaagagataacatgtatctaaagttctcatcccttatcaactaaatattatgaaaaccttagcttctcttgcttctccagaatgacagattagcttcagcctaccttagactaggcatatggaattggcaaacgctctccttagcaactgcaaagttcaccgcagatgcatttaacagaaatagcacagatacaattaagcaggtagaaagaaagaatgagcatgtaaaacacctacaatattccagatttcctgctcacttaattggatgattcagatacctctctttcataatgtccaggtgaaagaaatgccggttcctcttatttctctacatcaaactaaagctccacttaccagagcaaacacaagtacaatctgttatgttttggactgtctaatccattctctgtagtttcacaagaatctggtgagcttacatggcatccagagaacagggtgatgagtaaagcccttaactctacattgtctaaagaacctgatttattcaaagaggaggcagctctctcacttcttattaacagagggtagagagtttctttcccaaggccaagaggggttttagctattaatacactttctctccctccgtccctggtgtgtgtgtgtgtgtgtgtgtgtgtgtgtgtgtgtctgtttctctcactgtcaattttgagtggggtttcaaggtttaaataaggtgacaagtctagtagaaaaatctctgaaagagctatttgtagaacattaactgactagttgtgtgactttgtacaaccagcttaaggattcagttttataacagataagtttagggaaataaattgcactgcacattgccttcggtctgttgtacctcaaatagcttaggaatctgttttctcctaaaacatcttcctggaagctgggtttccgctccaccccacctcccatgtgtttatgcattcctctgctcctccccttaactgagaatcctcattagaggcctgggtaaaatgtttcattgttagagttataatatatcaataatttacattaccttaattttgtaatttcccagggcattttgaaatgttatgataacatgaaaaatgtatgactttcctcaatgaaaagttaattaacaattgcttttattcttcaatgaacagctttatggctaaattattactagttttgtttttaattagatgactaaataatgcaaaattagaccatctttgtcctgacactgaattagaccattctttggcaactcgtgtacaaactattttcatttttaaaaaaatgtatgattctgagaacaagtaaatgcaattagaattgtctttcagagggaaagtggccccaaatgatgtcaagaagccagttttatgataaagatgtctatttttatgaaataaaagtaaggagaaaaaaagaattaatacaacttcactttgagattttatttttttaattcttgagttaggctgaaggccagatttgtaattgctcgtgtatgtgctttctaaaacttgcttaaggaaaactggatggattttctaaaaggcaattaaagatttgcagttgaaaaatcatcctccctcataagtattggtgtatacagtggtttccctgcatggaggatatgctggacaatatattgagaactgcagctccaggcaaaattaaactagtgttttttagagatactaggattagcttgtttactaatttgttaaagcagctgcgtttacgaaatacataagccttaagttttaatcttagaaacaccctttcccaaatattctaacaagctcaatggtcctctgcctttgctgatatttagaacatcacgagagtctttaaaacttacagatgcctaggtcccacctgggaagtttctaatttaattggtttaggtggcaacctagtcactgggctgtttaaaagctccccaggtgactataatgcacaggaaaggttgcaagccattgaacttgtaaacaatatagcagctcccatacaaaagcccgtaaattcaaagaaaatccagccatatgaacaagaaaaaaaatgtcaacgaagcagggacttcataaacatatgtttgcaacaacacatcattgaatatgattaatttgatatatctgttttgttataaaatgtctagaaaaaaatgtaatgtaacaaaaccagcaagcaatttaaaacaaataggaaaagatgattagtagatcatatgatataatttttagataatacaggaatcggacattgaatttacgttagatttttatagacagatatacagaaaaacactcagagtagacaacaggatgttagcagtggtgctgcttaatgaaaaaatgagttatctgtacttttcttaatagttattgttgtatctttttatggtaaacatacattgtttttgtaacaggagagaaaaagtagtgttctttccttgaaccaaaaaaaaagtaggccatttaaaaattaatgaataaggaaaatacacatgaaaacttctggaataagaacaaagctgtaatcaaagaaaattaatagccttaatttttttatatttgagattaaagggaaaataagagaactaaacatttgattctgtaagaaacctttaaaaagcagtacaagaaataacttcaaaaatactatattgagaaatgctttcaaacaactaagtatgaattatctgtttacaaaattccaaaccatgaaaatagtatttaaacctctatgttcatgttctaaagcccttataatcttgattatgagacttcaaaaaaatagcatacacattgaaaactatcaaccaatctcaggaatacagacgttcaaatcttataaaacatagcagatttagccaataagagaagaagttatcatgccaaattggatttatttcaggaaaacatatatgcctactataagagaatctatttacatccttcattgtaggtaaagatcagaaggaaaaaatatacaatactttttagttatgaaaaagtattgataaatgaaaagaatctgtccctaatttaggagtagaaacaaaacttttagcaatgtaagaatagatgatagtttataagcatgaaaaatattgtctatctcaaaacaagagccaactctgtgatcaatgttgaaatattgaaggtatcctcattaaaattagaaatataactagaatgactaccaaaactgctctttttaaatgctattttgcatattctagtcagtgaaagaagccaagtaaaagaaacaggaagtataagtattggggaaaaaagtcaaattattcatattaatagatgatattgtcaacttggtactaagtaaatcaacaatgacaactattataactaatgggaaaaattagtcccaaagctcattaagaaaagaaaaaacctagaaataattaaatattaattaaatgtaatttttctaaatgctaatttctcttttaacaacctattgaaaatcaaagctatcattttccacagaagttcaaaatgtgaaattactgtgaatttatttagcatgaaatttggtgatatacaagcctttactggaaaaataacagaatatttgcatccatggacagatataattttatatttcttggtgggaatattaatattttagacatataatttactacaaattaagctaaaatctgatagaaacacataaaatttaaattggggtggcaggaagacattggatgtgacaagaattactctaaagtttatctggcagcaatatagatgaggattaatagaaaatgttgaaaaccttaaatgaaaggtcatttgcccatgtagctattagagtgtttaataaaacttctactggctgggtgcggtgtctcacgcctgtaatcccagcactttgcgaggccgaggcgggtggatcacctgaggtcaggagttcgagaccagcctaaccaacatcgtgaaacccagcctctacttaaaaatacaaaaattagccgggcatgatggcaggcgcctgtaatcccagctactcgggaggctgcggcaggagaatcgcttgatccagggaggcagaggttgcagtgagctgagatttcgccactgcactccagcctgggcaacagagcaagactctgtataaaaaaaaaaaaaaaatctactaaaagtctatacaaacagattagtgaaacaaaagagaaaatcccaaaatatgctcaagtgtatataataaaaatggaatttcaaatcagtggatagagatggactatgaaagaaatggttttgataatcatgttaaaaggcaaaaccctgctttacacaatgcagtgaattaaatttcaccttgaacaaatattcaatcataattaagcttaagaagcccaaagaacaggaagaacgataggtgaatatttctacaatgaggcgatggtagagaactatgtagaaatgattttaaaaacccaaaatttaaaatggaaaacacatagataatttttaaaatctgtacattaaaaaccagtaaactgaaattgaatcttacaaatcaattcagaaaaataaatgcattgcctaattttaagcatacaggaagaaagtgttagacctggaggtcattattttaagtgaaatgaaccagacacagaaagtcaaatattgcatgttcacccataattgtgtgctaaaaaatgtgtacacatgtacacagagagtggaatgatagacaatggaaacttagtagggtgagggggttggagtggagtggataatgagaaattaatgtgtatgatatatttgggtgagggacgctctaaaagccctaacttgaccactacacaatctatgcatgtaacaaaattacacatgtaccccatatatttggacaaaaagaaaataaaacacatccaaaggtatatgaaaaaatgttcgatctcatttgtaaccaaataatgaaaataaaaataacttttccttgtatactttgtatgcttctgacagaagactgaatcaatttatttcatgagagcagtttgcaataccaatcaagagaaagcgtgcttacacttgactaagcaattgcatttccagggaaattatcgaagaaatgcttacatctatgtgcaaagactgagttgtacctatatttattgtttaattgttattacagtgaaaaatggaaacaacaccagtattcatcagtaggaggctactaaaaaatgatatatctctaaagaagggaaatttaaaataaaattttacaggtgattgcattgatattaaaggtaatccaaatacatacatgaaaaaataaagcagactgtaatacacagtatgtatacatataatgctgtattatgatcccgcttatatatgcatatatattaaaatataaatttttaacctctgggaaatgcattcctacctaattttaagtctctcattttttcttattggaattttaaaaagtgtacaatgcttattaatgaatataaatttgtttgaatcaatgttttcaatttttaatcaaattatctgtacatgattcaagtaatttttacttcataagttcttttatttaaatatgctgcattcctctctcatttctcactcctcagaggcagatatttgagtcattctctttttctaatgcgtgacaaatctgtaataacatgtttatatctctaattcttgattttctcattttttcatggtctacagtctctcttatgagagatgaaaaattatctcatttatatctaccccatgtatttgttctattaactaatttttcttttacatgaagaccttaaatgttaatttttttcttcaaaacagtgtcaaaagtatgtcttaacccttcacatgataaaatggggattttagtggtcctccatgtttcttcacttctcctactgaatttcttctcccaaattctgtaaagtctacttttaattttatgttgagttgcattccttctgtgttctctaactatgattaggtctcgtgttttgtcaaagatttattctaaaaattgaaaacatataaacagtatgtacactattattatagcaccataaatatatttcattgcagagtctattaccgtgttgggcttatatttcctttcctatgatttccatggcaatttacctctgctactttacagaaaatttcaagattcaagttaaaatggattctctttttttttctttttttgttttttgagacagagtctcactctgtcacccaggctggagtgcagtggtgccatctcggctcactgcagcctctgcctcctggattgaagcgattcttctgcctcagcctcccaactagctgggattataggcacacaccgccacacctggctaatttttgtatttttagtagagatggggtttcaccatgttggccaggctggtctcaaactcctgacctcaggtgatccacccgcctcggcctcccaaattgctgggattacaggcatgagccactgctccagccaaaatggattatcttttcttacactcagtaatctctcaaattcaaataacgacataggaaattcctaagtctattgagtctttatctaccaaatctccctctctttcactttctctgtctctcttatgtacacgtagacacgcacacactcccttctcaaaaggtaagagaataggatggtttgtaaaggggaaacgtctctggaaacacccacactttaataatgtcttaactaatcacattgcttgggtgtttttgttattttgtagtttgcggttttgtttgttttattttctgataacctgcagagtaggaaagaagagagtccagaaacttgttgtaaagctggacttcaagttggaagaaatattggaaggaccttttaaaaagagagttgtatgatatcgaagcagcctatttccctgaccccttcccgggactcgtgacagggttgcctcatttacctagaccagttttcaactccttatgggagggagcatgcaagtgaattccaggggtttggggtacgaatgatcctgtcacccaggtactgagtatagtacccaatagtcagtttttcaacccttatccccctccctccttccccttctagtaatccctagtgtctatcgttttcacctttatgtccatgagtacccaatatatagctcccacttacaagtgagaacatgtggtatttggcgttccgttgctgcatgaattcgcctaggataatggcctccatcacagctgcatctgtgttgctacgaaggacatgatttcattctgttttatggctgcatagtattccatggggtatatttagattttctttatccagtccaccaatgatgtgtatctaggttaattccatgtctttgctattgtgaatagtgctgtgatgaacacgtgaatgcatgtgtctttatgttaaaacaattttatttattttggatatatattcagtaatgggattgctggattgaatggtagttctgtcttaaattctttgggaaatctccaaactgccttccacagtggctgaactaatttacattcccaccaacagtgtataagcattcccttttctctgcggcttcaccagcatttgttgttttttgagtttttaataatggcctttctgactggtgtgcgatggtatctcattgtggttttgatttgcatttctctgacaattaatgttattcagcattttttcatatgcttgtaggctacttgtatgtcttcttttgagaggtgtctgttcatgccctttgcctgttttttgatggcgttgtattttgcttgttcagttttttaagttccttgtaaattctagatattgaacctttgtgtgatatgtagtttgtaatgattttctcctgttccgtaggttgtctgttactctgttgatagtttcttttgctgtgcagaagctttttagtttaattaggtctcgcttgtcaattttttggttttgctccaattgcttttgaggatttagtcataaatgctttcctaaccccaatgtccagaatgatgtttcttaggttttcttctacaattcttctagtttgaggtcttacatttaaatctttaatcatcttgggttaatttttatacatgtcgaaaattagggatccagtttcattcttccacatatggctagccagtccatttattgaacagggagtcctttcccattgcttatttttgtcaactttgttgaaaatcatatggctgcaggtgtgtggctttatttctgggttctctactttgttccattggtttatgtgtctgtttttgtgccagtaccatgctgtttttgtttttgtttttgctcttatttaaatgttataaaaattgcctatatttaagatgtataatgggatgttttgatgtgcatatacgcagtgaactgattactacagttaagctaattaacatatccatctcttcacatagttattttgtgtctgtggtaagaaaacttacaatttactctcagcaaatttcaagtatacaatacagtattactgactatagtccctatgctgtgcattagatctccagaacttattcattgtatgtaactgaaacgttataccatgctgattcggttgctgtagccttatagtatagtttgaagttgggtaatgtgctgcctctggctttgttctttttccttaggattacttttgggctcctttttggttctatatgaattttagtatagcttttttccagttctgtgaaaaatgatgttagtggtttgataggaataacatttaattcgtagattgctttgggtagtatggccattttaatgatattgattcttctaatccatgagtatggaaagtttttctatttgtttgtgtcatctgtgatttattttagtagtgttctgtaagtcttctcatagagatcattcacctcttttattttttatggctattataaatgggattgcatacttgatttggtgcttagcttgaaaattactggtatgtagaaatgttactgatttttgtatattgattttgtttcctgaaactttactgaagtcagtgctatttttagatggatatatgagaatatttaacttatatggagagtcatagaaattacacaatttgtatttcatacatcatccacacacatgctttctttacttaccagaatagtggaaatgctgcataaaatgaacttaatggtttttatttcctttcttcataaatgtacagtttatcaagaagatgccctttggcttactgacgtgtaaggagggactaaaaggaaaggaaaaagaataggtagctctaacttttcctttctgtctacatcatcattttttattgcaaggtggttggccaatataaggaaggaacaccactaagaaaagatattatgtggttttttggtcattagtgtttcttagaatgtcactcacttcttcctgcatatatatatctcaaatatatatatacacgtatatacacatatatatacatatatatctcaaatatatatacatatatatctcaaatatatatatatacacatatatatttagaagattatttggtgaatacactattagaacaaaaagaaagaagtattagcgaagtgacagggtatttcccaactcagatatatgatacctgctaatggactgttcgtgattataaatgtagtatatgctcattgtagacattatgaaaaacgtaaaatcccctataattagacctctatttgtgctaggcacatgatgacttttcttgctctgcaacaactattttttttctcttaaagtttataatgttgtcagtattgtcggatatcctcagggattccatcatcttttcttaattgtggttaattacttaaccaattattacaaattattttcctataatttattgctcttagtatcaaacaattaaacaccctaggaaatgtcttattacttgatctatgaactggtgagaatctatattctacataggggcttgttttctggttttaaatctaatacagtcgtttggcaaataaagacaaaaaataaatgttgtctacctacttttcaattatccaagtagtttaaaataaaaacatccttactgattttttaaactcttatataattgcctaattctacagtaactggggttggtagtaactaaaacctgttgtattcctagtgatgcccaatgagccttgggaaatgaataggtgggtatagtccagttgctagaaaatacttgcttgttactgacttatctgagaggaaataaacactttcatttatcagggacagagtataaagtgttcctcactgaagcatttctaaaagctctacagtcctttgaatactgataaggactctgaaatgcaagggaaaatatgcaagtaatctggactatcacaggttattttatgaactgctcatatttttactcctttgataagtattatttcccccaaccccaaacccgataaattcgataacccttttcatatataatattatcagcaaggcatcttagagtttcctttaaaaaatgtaaattaccaagagaaccagaatgattttggggctcataatggtagatcttaaagagagtggaaagatcagtagttttcgcattttgctacacattggtggagtgtttacaaacagtgatatctgcgttctatttccacagagtctgacttaagtggtctgtaatccgagcatctcagtttgaaaagtttcctagataattttaatgtgtatccaacgttgaaagccagagtaaaatgaaggaagttctggggcctcagataagcaacttcactacttttttcaggttctttgaataattgacatcatccccaaattcaaatcgttgatagtcatgatgagtacctgttttactccagaaatctatataatattggttacctcagtgcttgctcttaacttccataatcaaaggaggaagagagactcatcgtgttcagatacaggttgtgtaacgtgtgtctgtaaaatactaatgtgattgacttcatccatccattcacctatccatccatgcatccatccatgtatacctcgtgtacctccattcgtctactcatccaatgtctctgtctaggctccaggactgctgccttaaggttgtttaccaactcagtaggtagtatgttatcctcaggctttggaaacaggggggtttagttaaagagcaaaccaactcaacatactagattaacttgaaagggaaaagttatgcttagtgcataaattctttccctcttgtcctttcaaatccatttttcattctttaccactgtgctttgtgtcctggggactgccctttaggaatggcatcagagttcctttgccctacagtttccagttgagacaggctgcagcaggaggagtacagtggataagaaaagggtggagtatttattttcatgtggccccatgggatttccacaggttagctctgaacagctaacattagaccagagcttctgctggacagttctctcttgcatttctattgggtctggctctctagttcaggaaacgtccttcctcttaacccttgaggtctacagttaactctccgtcatcccttcttgaatttcctaacactgagcatatctctgttgataacccctttagcaaactggcctcacataccccgagattgagaaatcaatcctccagtttctaccgggactctgattgagttaatgtgggataatttgcttacactaccctcttataaagtgactatgtacattagcatattaactcctttgaggattttcatttacttttgttattaaagcattacacgttttttgataatgtgtaggagactcaatcatagccagaagtgtctcagacgcaagcacctgtaatgattcccttatatacagttttatcccaccagaaattgggactaggcacaagtgttctaggtaacatttcaggatcctactgtcataaagattattatggcacaaaaactatttggctagaagtatccccagactcctctgtgccacattatcttcctttatccagttatctgaggatgtgcttgcagtggcagactagcttttggggaaattttatttcaagaaaaaaagcagggaggaagaaaagggtaagaaatgaggaagggaagaggcccatgggctaggagtgggctgtcctgtttctgggaaactttgtgaaggtttcaggagtagtagtaactcatggtgaatgaaaatgagagggaattgttggcttttaaagtaataggatatgcccctttatgatgggattaagagatacaagtaagctgggcgcggtggctcacgcctgtaaatcccaacactttgggaggccgaggcaggcagatcacctgaggtcaggagttcgagaccagcctgaccaaagtggaaaaagcccatctctactaaaaatacaaaattagccaggcgtggtggtgcatgcctgtaaccccagctactccggagtctgaggcaggagaatctcttgaacccaggaggcggaggttgtggtgagctgagatggcgccattgcactccagcctgggcaacaagagcaaaactccgtctccagaaaaaaaaaaaagagatacaagtaaagttatgaaatcacctgtggtttctagacagttttttttgtgtgtgtgaaatattaagaacagaatacatgtgctaaaacattttaaaagcttaataaggtcttttaaatcttgcctcttccttttgctcgtctaatattacctcctatgtccacccccacggattatttacatttaatgctttctagtgaaatcattaaaatgagatttatggattattcataataggcaggatgaaaaaggaaggtgaggcgacagtgatccttccttagctgttaatggataaggagtttcacagcaagaggaaaaaggcataacattagtattaccggttgtctaagggggagagatagaattgtttttttttccttgcattttctgtactctactcttatttccaaatattctttaatgtttgtgtgactttgtgacttctatattcagcgcaaaaaggattaaagaattaatttaggaaatcaatttacactgagtgtctccagtgccagagagggagggaaggacattcgtagctacagtgttcataatagcaaataattgtattatggtcataccatggaatattatatagcagtataaataattaactatgatcacatgtaagaatatgagaaaatcataaaaacataatgtagaggtccacaaacattttcttaaagggccagatagtacatatttcaggcttctaggtcatattgcaaatacctaactatgttgttgtggcatcaaagcagccatagttattatatgagtgaataggtgtgagtgagtctaataaaacttcatttttaaaaactgtcagggaggccgggcgcggtggctcacgcctgtaatcccagcactttgggaggccgagatgggcggatcatgaggtcagcagatcgagaccatcctggctaacacggtgaaaccccgtctctactaaaaatacaagaaattagcggggcgtggtggcgggcgcctgtagtcccagctactcgggaggctgaggcaggagaatggcgtgaacccgggaggcggagcttgcagtgagccgagatcgcgccactgcgctccagcctggggaagtgcactcactccagagccggggagcccatgggcggtagtgtgctgacccttgtattagacaacactccagaaagctcaagcataggaacacctaatgaaaatattgttttggcatacatgcatgtgtgataaatcgaaaaaaccaacacaaaacaaatgagcaaacaaaagaaatcaaaggcaatgatatgacaatccccagattctggatggtagttaatcctgggtaaatggagggaggggtacaaaagagtgaagaactagtgtaggagcacataggttcaggtgtgagttgttgctaatatttcagttattgggatggacatatgtttgttttattattgagctttgtaatttacatatccattacatatattcttttatgcatcaaatatcacattacacaaagggaaatcataaaaattggggaaaaattggaggcaagcatagatcttggggcccagtgtagcatgcttttttctatttttaaatttaaaattgtttttagagatgcggtatttctctgtcacccaggcttgaacccctaggttcaagcaatcctcctgaatagctgggattacaggtgggtgccacttcacctggctaactaaaacaaaattcttttaaagatatggtctctctttgttgcccaggctgatctctaactcctggcctcaggtaaccctcccacctcagcctcccagggggattataggcacaagtcagtgtgcctcacttccttcaacattcttaaatacatcttggaagcacagtgtttattaccttgtttctaaaagagatgcatctattgtaatcatatttataatgttcttatatatggttttcattagttttactgaaactctcaacctattgttttttgatgatgactaccaatattcattgattcactgataatctttgtaatgtccttaactcttagggattagatgacattaaatctttatcaagaagtggattttgttacttaagtattttagtagcaacaaaattggtcacaacgacattccactgaagcagaatagtcagaaagcaatccaagccgcagaaataaattaggttgagcaagactacacctaatggcattgagataaagaccctactcctgactcactgccccgtgttctagtggtgtgcctgctctgcaattctccttaagttgatgtgcatctatctctttaggaccagggggtatttagtctgtaatggcttttccggcaacgtgtctcatttcagctgcttcagttgtcgagataacactctcgtcactgcctctctgatggtttcccattcaacagcagtcatttcatcttgggacacttttcctcacagtcaacagtttttcctttgtgtaattaagtctcatttttttctggatagatccatttgtgccagaactcttctgctgccttgaagcctgcaccattcagttatttttagtgttatctctttcctttcattagcacagagctaaattgtgcatattttgttctttcagctttatacagattaagatcttctagctccttagtcattcattttagctgttgcattgaatttcctacagttcatttaaatcacccagttcagtttaatatgcccagaataaataaagcatcattttttttcacatctaatcacctaccccgaccaatggcaagtgtaaggattataaacctttgtgactttgcctgtttactcccttagtaggtgagctctgagccaaaatataaattcattaaagtttttcttaatatctctagtctctacttctggctcccttccctcagggtattatcccctttacaaatatttttttgtgtctttaggtttccatttgttttttaaaaatacattcttatcaaaacgggaaaatattttcccatttctttcataaaccatgttttctcaatagttatctctaatcaaatacaagaaacagggaaataggtagtgccttacaaaggaattttagccatatacgtttggataaggtgaattttccatatcctggagatggttttgagtactcaggaggctacatctgaaaaaaaatatatagttattctctatctgggagtcaacttaattcttttgatggaaaaatagaggctgtgaatccccagctccagctggcagagatcactttgctcagaagttttgcacgtaaaaagaaacttcttttctgggatcactgatttatttcagctgtaccctgaaactggtagtcagatacaccctgtaaccagcagatctgatattctccagccttttcgggcttgtacatcaatcgtttaaactacactataatggggatcatttgccaaagctcattgccattctcttctagtcataccaatttataattacttttctctcaatatgtacccacgactctcctttcttcacccttatgatatttattcaaatattaaatgttgccctttttttctacctttattccaaatgccttagaggtctggcgtaaactatatggctataacctattgcatttttaccccatagatggaaaatgtattggtgaattgtttataaggttggaagttcccctgaaaataaaatccacccaccccactaggggagtacggaaactatatataatatgacacacatcgctattacttttattacatatgcttattatttattgttcaaattttcaaatatggtcctgcacacaggcaattttcacaaaagagcagtatcagtgttaatcagtttgaaacaggaaaggatttgtgaccccaccttacaaaatacaattccttatggttacaaaatctcattcaaatggattctattgtagccatatcaataaggaaactgatctatcagccaaaatcggaaatagccctgataaagtagactgagcttacattcatgcacagatgtttgctcattatttttacttgataaggacagatacgtttgtgtttagcataatgcgtgtgtgtatatttgaatagattttctagaccctcattttagttctagtaacaattgtctggttctgaatagggactttccactttacagaagcaggcaaaatttaatttgtcatagctaccactgaacccatttcctttatatactcaatctgctttgacacagtagatattggagtttcaaaccttaaaatgaaatacagctttatgatgaaatataagttgatatgaatactttcaatatacctatattctatgttacactcagttagctggcatttggtcttcactcatggacattttaaaaactcatacattctttagtgtttgataatgtgacaaatcaaccccctataaaattaactttaaatcaattgatacgttagcatgtgagtatatgtgtgtgactatgaatacatacttatataagcacacttatatgcttatacgtttgtttgaatctctcactgaccttagccataaaaacacttttattctgttgatttatacctcagcctacatgtgaacaaaagattcagcaaatcagaataacacagttactctattttctaatttatttgtaataaatatgcattacctgcataacgtttacatcaatatgggcatacattacttatgcaatgtaatgatctaaataacgcaactatcgacagtaaccacgcactctccccctagcaattacagaatacagtttctctgttgcacaacatgcctgactatcgtaaatttagggttatctccttattaggattccatttacactcttaatgaatcatatttattttatagcagcttattagtaaagttgactgccaagatataggcaatacatacaatttcctcaaaaactggggctttcactgttaatttaacaaacctatatgaatccatataatatatgaatcatatgaatatatataatatgtaataagataaaatgcataatttaacatatatgaaatatatatagtattaattgttaatatgtattaatatagtataaaataatatatataataaatgtataatatataatatatgaatcatataatagaaaaatatatgcatagacttgagttaggtgtaaagaatggaaaaattaaaaaatagtgcacttgatgagttcacaacctagtatagtgtgtcatagagaatgtagcattttgtgtatgcaatagtaaatatatataatgcaaaagaaatgaatggttttgcttagggtaggaggaatggggtaatatttgagataaatctcaaagcatgtaaagatttatcaaatgaagaattggggttatggaggagtaggggttgcattccaggagggagggaccaacatgtacaaaagcttaaaggaatgtaatttcatagtatctgggaaggacaatgggtagctatatgtttctgaaatcttgaatgcttgggtgaaataccaaaaatagggctagaaaagcaggttatgattagattgtgaaggcatttaaaagcgtcttgattagttgggaaataatttctacaacgttttagttgtataaataacaaaagcttcttttaatccagatacttagtggaagttcctctttctctaagtagaatactagacctaataataataataataataccgtatcatatatttttattacttttttggttttctgactactttcaagtacagagatggtccccgacatacagtagttcaacttaacaatttttcgactttaggatggtgcgaaagtgatactcatgctgtggaaaccatactttgaggacctatacaactattctggttttgactttcagtatagtatttaataaattacatgaaatattcaacattttattataaaataggctttgtgttttatgatttttttcccaactgtaggctaacgtaagtgttctaagcatgtttaagataggctaggctaacctatgatgtacagtctgttaggtgtatcaaatgcattttcaagtttcaaaatttccaaactatgatgggtatatcagcatgtaacttcattgtaagttgaaatgcccatcaaagatagactggataaagaaaatgtggcacatatacaccatggaatactgtgcagccataaaaaattatgagtttatgtcctttgcagggacatggatgaagctggaaaccatcattctcagcaaactaaaacaggaacagaaaaccaaataccacatgttctgtcttataagtgggagttgaacaacaagaacacatggacacagggaagggaacatcacacacctgggcctgtcagggggtggggggcaaagggagggatagcattaggagaaatacctaatgtagatgacgggttgatgggtgcagcagtccaccatagcacgtgcatacctatgtaacaaacctgcacgttctgcacatgtatcccagaacttaaaatataataataatataaaagaaaagtatctgtgcttgatgggttttgatatcctcagtaactatggccaattagttgaacatggcacagtattatccatttgcagtagaggaaacaaaggagaaaccagaggaacagtgagagagagagagagagagaaagctgctggtcatgtcctctttccagcatgtcaccctccatattcttcttcaaatcaaaaaacgtagaacggaagggagcttagtagcattcagctctgctacactgcacaccagctatacacacaggcaatcaatatggtttggacacagctgatataatttggtggagctctaattgaatttttccccttcttaatataattacacctacagaacgtctccaattaagtgtccccccatcagtctcaaaattaaatataccaaatggaactcattatctactcccacataaaccagctcttcatgactctttcccctttctattaagcaccactgcttccaggctcctatatctgaaatccctgaagtcgcttatttttgtattcctttctccatcccgaaatccattcagtcactgaatgctattgactaatgtttgaaattatatctatgcataccttcctttacgttatgggtaaatgtttttggaatgtgtttaaacagaacaaggaattggtgaacaaaagaataaagccatgcataaacaaatgtttattcaccgttttcattatatttgtttgtagtactgcaacctaaagtttgtaatgtctgagaatatctgattgtaagcaattaccccaaccccatgtaagttaacagtgttataactggtacgtctccttataggtgaatttgttcaaagttgcttaattatattttaaaaatctcttattttagaaagaactctcaattgctttactctgaataagataatactgtttagaagacaaatcattgcaagttttacatctgtaagtaggttacctgatgaaacggattgaaaaactgaaggcaaatattgaatgttagattattcccaggtatctgacttcatcttcttacttgctaggtgtcattgttaatgataatttaaaaaatcacacatacctacgtatccacatatacaaaacagtaagcagtcatgctattgaattcacaaatatacaccaaaagacaaggggaaaaatataaacaacagctttcttactagcaagcagagtgtggcgtgaggtcaaatttttatgacgaagagcatacatattcacaaagtaatttatctcaacttatgtagctggaaatggagttgatgggttctgaaaaaagcttctagatgacattaaaaaaaggggttcttatgacaaagaaaaaaattacctcaaagtagctttcaaagagatcgaataaagtcatttcatgaaatgcgagactaaaaaacatgccagcatttctaatatttctaatgttttatatgatataaatatgaaatataaaaatatttaatatttttatcatagaaaattaatggcatcaatttcttatcaaaatcatgcatacaattgattatatatatttgctaaagtcctaaaattttgtgtatacatgttggcctaaaatatttttgagggctcacaggcatattttcttttgggaaaatggaaactgcctaatacatgagatgatttatatacatgctgcattttacaagcggttagggaaacacatgtctattttttttctaaatcaaataatccgtgtgtgcaccatgctaccttgaatatcagattatcagatttaccatccctattagggatataaatgttccagaagaacataagagcaaatttttagaaagattaatacagaatctaaagattgaagggataagatgatttacattaaatctgtttccaggatatcctagttgggaaatcaacctaaatacccgaaaacttaaataatccaagacagtatgcatttgcttaacagactttttctccatcatttgtctgtgtttagtaagataaaagaaagacttgcggccgggcgtccgaggcagcgggtcacctgaggccgggagttcaagaccagcctgaccaacatggagaaacatcatctccactaaaaggcggaggttgtggtgagctgagatctggccatcatactccagcctgggcaacaagagtgaaattccatcaaaaaaaaaaaaaaaaaaaaaaaagaaagaaagaaggaaacttgctacccctcagtaaacaagttatatttccttcataactttcttcctataaggcaataaacaaatatttattaagaacctatcatgtgccaagtaaataagtactctgtcaaaacaagttagattcagagtgggctggaatgatttggacagaagggaatgtgagaaaggctagataagatggaaacttttctgccacaggcataccttcccagtagacgaagtagagatacaaataatgtagcgaagggtactatggaataaaaaagtcaataaatttatttatttagtgattacagctacgatttgctaagcaattaatatatgtcagacattaagccaagacctctgcagatgatgccatgtttagatcttataacaacctagtaaatgtgttaggatgatcaaatccattttattttatttaaattaaatagttaattttaatggatagaaaaaattgtttatctttatttcattcaacatgttgttttgaatatatatatatgaatggctcagtcaagctaattaacatatttattacctcacatgcttatttttttgtaggaagaacactttttttttttttttttggagatggagtcttgctccgtctcccaggcaggagtgcagtggcttgatctcggttcactgcaacttctgcctcacaggttcaagcgattctcctgcctcagcctcctgagtagctgggactacagcctcacgccgccacatcctgctaattttttgtgtgttttagtagagacggggtttcactatgttgcccaggctggtcaggaactcctgagctcaggcaatccgcccgcttccgcctcccaaagtactgggattacaggcgtgagccactgcacccagccaagtgaaaaacacttaaaatctactctcttagcaattttcaagagtataatacattgttatgaaccacctgtagaatcaacatgtacaatagatctctcgaacttatttctcctgtctaaatgaaattttgtattctttgatcaatatctctgcaagcctcacaccctcctcccagtctctggtaaccactattctactctctacttctatgagcccaactttttagataccacctataataagcgagatcatatgttatttggctttctgtgcctggcttattgcacttagcaaaacttcctccaggattatccatgttgtcacaaatggtagattttcttctttcatgtctgaattatattccattgtgtgtgtgtgtgaccacattttcattatccattcatttgttgatggacatttaggttgaatccataccttggctattgtgaacaatgctgcaatgaacacgggagtgcacatatcttttcaatataatgatttcatttctttgggatacatactcagtaatgggattgctggatccatactcaatttaaagatatagaaaacaagccataaatatttatgtcccccaatatccaaaagttaatcaatggccaaatcagcttaatttgtctgttttgtttttactatcaaacttaatacattcaccaatgctctttttcatagttgtagccttttcttgaagattataacgtttagtagtttagattgttatgtagacatgtggtgattaaagtaactcctgcaattaatttaactaattttagttatcatgtactacacttttacatactatttccctcaaaaatgttaaaaagcctttcttaaagcctttttagcagtgccttttatatttattcgtgttactgtttcatcaattgctttagtttggtgacagtttcatgtagttcatttactggattcaagttacagtccagttacttgaggggcccaaaagttaaggacttctgaaagtgcgtgaattgcttctactcactgatgcatcccaaacattcagatcttgttacctgaatcaggggttctattctttaaagttccttggaggatactatcagaatgaaaagactcaaaatagaagtcttccggaatacaatgttgtggttttaaacttaaaagtattgccagtacaacgttagtatctactgaggtggtcacactcattccagcaggtcacatactgagaactgcataggctttgtatggtaggccaaaataactttcagattgagtccatcaattatttttctaaaaaaaaaaaaaaaaaaaaaaaaaaaaacccagagtttttgaaaaacctacttagtcatttggaaaaatactatgacattgaaaatcatattcctggaatccctaaacattattaccaaaaccatcggccacagagctgtcttctactttttccccaaccccactaattccgagtgtatctgttcttaatattcaggttatacttaatattccatcttaatattttattttaaacacgttttatgctaaaaatttacacatatatttataatgttctttctttggggatatgaggattctactgctgacctactgctgaagtactaaaaaatagtacttcagtgtgtacagtaatagggttgagcaatttattcatgtcccagccaatttccaagtatccacacacatttcattggcaaagtattcatatccactcatcagagtttgtaatgtaaactgtttctaaagaatattttctcactctttcagaggagaaaatcagtgtattttaaaacataaagctaataaattccatcacacagaaattaacttcaatagggctgtggtttgaaatatgttgtaatccactgaaggaactcaggtaaaactagtaggttagctaatatttattttttatttttatctttaagggacaagatctctctctggcacccaggctgaagtgcagtggcatgatcatagctcactctaaccttgaattcctgggctcagatgattctcccacctgcacctcctgagtagctgggacaagtgcacaccacgccctgctaattttctttttatttttcgtggagacagggtcttgctatgtttcccaagctggtctagaactcctggcctcaagcaatcctcccgcctcagcctcccaaagtgctgggattacaagtgtgatccatcatgcctggtctagctaacatttttcttttttcttatttcataaaattgagactcactttgcatccatagacttatggaaacattttgaatccagatgccgtagccatttttttgtttgttttggtttgtttttcaatatcaatagaatcttttgtaagcaaaagaaagcaaggacttctttaataatttctgatttttatcgtggcatttcctcactctcctcatgccagcatagtccaaagttgctatttgctcaacattattcaggtacttaaatgtttaaacttgatagtttttaatgcatctataaatttaaacataattctggaaagcttcattttctataattaaaagtgataatctatcttattttaaatgtatttctgtcttgggtatcttttcctaattaaaatttaaactcttattttacaatgagacgttacctcatttatttttcattaaacaaataaaaccagacaatccctgaaaaacctatgaagaattatctttttaaaaatataacaaatccatgtgatgaaaactatctttttacatcaccactacacagaaagtttttcatttttttatgtaatcactattaataaaatcatccatgtaggacaataggcaattatcgttaacacctatagcaaagcatagataaagttgattttttgtttttgtttttgttttttttttaagatctcacttctgttgcccaggctggagtgaagtggtgcgatcttggctcactgcaacctctggctcccggggttaagcgattctcccacctcagcctaccgagtagctgggattacaggggtgtgccaccacacccatctaatttttgtatttttagtagagatggggtttcgctataatggccaggctggtctcgaactcctggcctcaagtgatccccctgccttggcctcccaaagtattgagattacaggtgtgagccactgcgccccaccctgacaaagatgattttactttatcttaacctcatcctcataatggggtttgataattacatttcatattttgatcacttaaaattatttttgttagtagcattagtattttgtacatgaggaaaaggtgctatgtaaccatcaaagtacagttctctttctaacggtaaaagtggttgtgcaaaatgtagcagttaatgtctataaataggagacatagaattctatgtttctctcaagaagaatttctgttaaaatataggaaaaatatatcaattcatatttggtatttatgtagattatgttatagtactcctattttacttttgtaatttaataagggaaaactttttaaaatattcattcagtgagtaactttattgagactctacaatacagtgtaagatttatataccaatactacaaccattttactgacagaaaaataaaaatctagaacagtttcagaaatgctgcctttttatgctgttctccccaaagcaggggtccccaaagcaggggtccccaaaccctgggccccagaccaatcggtccgtgacctgttagaaaccagggggaacagcaggaagtgagccccgggcaagcctgagctctgcctcctgtcagataagcagcagcattacattctcataggagcgagaaccctattgtgacctgcgcatgcgagggatctaggttgtgtgctccttatgagaatttaatgataaatgttgtaatgtgcttgaatcattcccaaaccatctccccagcccaagtctgtgaaaaaattgtcttccacgaaaccagtccctggtgctaaaaaggttggggaccacttccctaaagcttagggggtaggtctaaatattttctcaagactcctctaagtaaacacataaaagcataattttaatgaaagcacttgtatattactgcaaatgtgatacctgaacttttgtttgcttgctttcttgtttgttagcttttgagaatacaattgtttttattacttagagagtatacattgaaggaaattataagaattttcatacttgaaagggacaaaagaatatgcaataggaaacagtaaaaaaaaaaaaaaatcatgtcagggctttcaaacctatctgcagaattcctttcaagtttcagtcctttgggggagccttttagctctctgcaccctctccttctgcttatgtgtaagccttggtgatgcatttaccaaacccttcatatctgtaatcatgaggtagcttttctccttcattgtaaatttagggatagtagaaactgccttatttaacattgtatctcttatataaccttacatgtaccatacatacatagagtctatgggataaataaacgtttatacaaattaaacatgagatggatgaagagataaacggatggatggatgaatggatggatgggtgcatggataaataaataaatggttggatgaatatgcttataattatttctatgtaaaatatttttagtgttaatgacccccaaagtgctcttaaagctccaattacctagttaattgcacatagtacaaaattcatagaggtaaacaaaaaagaacgcataaagaaaattgtttctcctattatgttagctagcctcctagttatcctccttctctcttactgggggtgctggcattgcggttttctgtgtattctttcagatatctgctgtacatacatgcgcatagtcatacacatggccacgtatatcagttcaaatctgtcaggaaggtatgagaacatcaatttcctcataccataaaaaacgcagtatactaccaaacttttgatctttgccaatatgattggtgaaaaactatgaaactatgtcttttagtttgcacttatctactcaggaatgaggatgaacatattttcaaatatttaagagcaatttttgttactttttctctgaattctgttcgttttctttgcaagttataatattccttccaaaattgttttataaccagttgacagatgggaaccagtctctaggtggtatcagaaacagtgttatccagcatattcaaacctaccaacttattcgatttatcactatagctaattgtttgagtagttcatacatttatttacactatcaagaaaaacagtttcaacattcttgaccatatttaaaaatgccttttaggctacaaaggtagattgaagagagaagttccaaacagtaatgaaggcctctattccatcccagggaatttgcaaaggctctttcctggacaaacttgtgctattattttgcatgatggaataattttcatccttcaaatctgtttaattgcacatccaaaaaaacaccttctttgactatgaaatccagactagttctctctccttccctggactctctattttaggtactttctatctgaacatcttgtttatttcttcaataacacttattatattgggtgattatgttattttgtcatttatttgctattccctacaatagattggaagttccatgagagtagtttccttgcatgtcttgtttactgttttatcttcactgcttgatccatagtgtggcatgaagtaaacattcaacaaatatgtgcggaaggaataaatgaacatacacatctaatttctggtgtgtttatcaaaaattcaattgtatacttctggtagactgaatttaattcaattgagtttttcccatgtgtgataagaaggatagggaaagggacagatggaggatgagagggtaggagagaagaagagagaaagagatgggagggaggagaatgtagactctccaaggagcctaggctttttactgcatttatttattcacaatttactgcaaatgaatttcacagacacagaaactgcaagcttagacaccatcattgctctgagacaaatgcatccagagtgtatttgaagttcagatataattgatagataaatgtaaagctgggagaaatttattaaaaatgattggtaactcataactttcaaggaagtgaattgtttaaaaaatgtacataatacttgggttagatactgtgtttcttagttaaaatataataatatatgtatttcaatagatcatatatgccaggagacacctgggcgtattgactattacataatagtgattatctttatccatctagtgtttgattgaggacggaggttgatgtatcaaattaaattaattgagatctaagaatgacatcaataaacaaaatgttaagtttcaatcttcctttttgcatatgtactgctttaatctttcggctattgatcaccagttatgtttgcaaagatcacatttaggctttcctttacagagagatttaacttaccctttaaaccatgagtcagtgcttttagttttggggatttagtttccttaaagccctctgagggaaagaagggtatatatagttatatatctccagagaaattgaatatcaaagtctatataacatgtaatttatcaatgattattaactcctgcacttgcctgtgactgcctgtatttggtgatgaagaaaatatagaaaagtagatgattagaatagggaacctaggaaataggaattggaatgtagataatctacagaacaaatggtatcttcttttatttcaattgtcatttgaaaaactttctttgaagagtaaataaaatataacaaatcgggactgaattcagtagaatagactgaatactactaaaacataaaaaataaaagagctaaaaggtaactttaaggtgtagctttatgttcttacatttatggcatgagtgcaaggaaaggctcaacagttacatgcatccatttactttatagttgaatagtaaaaaataatgcagtgaaaagtaatacttcctagggatgttcttagacatgcaacctgatcaaaaaagtataaaacaggttggatagtatctctggaatctcccattaataccaacaatgccttttcatcaaccaacactatttgccatagtcttctcaattctatctggacttcctgattttgatcttttcaagccaatccttttacacactgctctcagacttagtcatctaaagggtctttgatgatctccattgtcttaagttagaagtcctaagcctggcctacaaggttctctattttttgtcattttcctattttgacttatttcctccactctttgactgtcctacttaaactttaaggcagtctccttagacctggaatgctgtttcccactttctcaacctaccaagcttttgaacgtcctttgggacccagacaaaatctgatctttgccgtgatacatttcattaattctctgaggtggaattagtctccctttcctttgattcttctgtagcacctgtaagaacctgtacaatagcaggtatcatattgcatggtaattattttccaaatgtccttctcctcattccaattatgtgtacttcaagggccaggacattgaatcattgtgtgtatcctatgctggaaatatattaagcttccatagagttctcatgtaaattattgtgaaacatttttaatgctatgaagaaagcattttaaatctgtttaagaatacatgttgaccgggtgcagtggctcatgcctgtaatgccagcactttgggaggccaaggcaggcagatcgcttgagcccaggagttcgagaccagcctggacaacatggtgaaacctcatctctgcaaaacccacaaaaattagctgtgtgtggtggtgggcacctgtaattccagctacttgggaggctgaggtgggaggtttcacttgaggcgggaggcagaggttgcagtgaactgagatcacaccactgcaccatctgggcgacagagtgcgaccttgtcacacacacgaaaaaataatacatgttgaaactttgggaaggttttgaagcaagttttgattaaataggacttagatttcaggagtcagttttatcttcaatgcactcaaatttttcagataataaaattatttaatatacagtcatactaataatatagacccttgcaatagataagttggtgtgtatgcgtatgtccaacagaggattcctacagtcacatatattttagccataaaataggaaatctaaataagcacctttgtcttagacttcagcacaataggtcgaaccttcatttgaatgtgactagggactgccaagtccctactgcctatctctaccaaaggctgatctggaagtgaacccttttctttctttttttttttttttctagcagatgaatgttattgagtttatctgtggtctagtgatgatacctgcagagcagcttcatttttcagagtcattcagaaagctatcataagcttcttccttcttgtcaggcagagcaaatcctggcatgacaggatgtactgggagtctccgatagtgggaactgacaaagatgtgccttcagcactcccacaaagccatattgtctttctggaaatgaggaggatttattcagcaaatctaagtgtaaactaggagacccatcagataaaatccatacaacaaagatcaccaaccattttttcttcttctgaatagagccagaagatgcaatttaccttcttctctttttttccccagaagtgacaatatagagttagagagaaattatagagcggagattttgaaattcagtttcctccccaactaccagttgaaaaagcatagccttaggaaatgttctcatttgatttcctatgttttataacatgttatgtttgtgaatttgtgtgtgatgtgtggtggtggtggttccaaaatatctaagatatatagtaaatgagcaaacaaaaatagtttgtagcttttgatatatcatagttgtacatattttcgtgttacatgttgtattagttcatttttacacagctataaagaactacctgagactgggtgatttataaagaaaagaggtttaattgactcaaagttccacatgactggggaggcctcaggacgctgacaatcttggcagaaggtgaaggggaggcaaggcacatcttacatggtggcaggagctgggggatgtgggggggggggaagtgccacacttttaaaccatcagatctcgtgagaactcactcactatcacaagaaaagtctgagggaaatctgctcccatgatccagtcatctcccaccaggtccctcccctgacacaaggagattactatttggcattagatttgggtggggacacagagccaaagtatatcacatgtaatattttaatcatgtatatactgtataaatgatcaaatcagagtaattgggatatccatcatctcaatccttcctttctttgtgatgggatcattataattattctcttctagctattttgaaatatacaatgaattattgtttattatactaccatatactagaaaaaatgctctttaaacctcatcagaacacttgctaaattgtctttctatatgcttatgacaacagtaaaaaacaaagatcacatgtccaatattactgggctgtgcttggaaaaaaatattttactcttttttaaactttagccaattatatcttcaatagatatcaacactaatatcacatctttaaaaagtttctatgggttttagtaaggtatataaaaccatcaaatatattatccagagagacaatatattgacatttaaaatatgttcttactcatttatggtatcacctactgtcagaggtaaagtaaatttaatgatgtctaaagggattacagttgcttaaattggctagagttttatatgatttatattttcattcttttctggacattggaatcaagtagtaaattttgaaattttatattatatttttacttatcctgtttacagtatcacacctgactcaatttagagtagaaaatatttctagttacccttcgtcagaatataaacatcttttcaaattcatttcagcattttaattgtgttaatagaaatagttcaaaaatatagcataaacctcagcatgttctattttggagagaaggaggacaatgattgttgactctgatggatagtttcccaatgtgaaaagagtaaatttttcttcataataatattttatttcatttcatatggtactctaaaataggcaaaatatacctttacctctcttctgaatactagaagtagaagtaaatgattttattattgacattattaattatactatatttatgttgatatgatgccttacagttcatcaatcattttcatatattttaattcatttggccctaatagctgtgaccacctcccagaatagcccagtcaaaagaggttgaaaagaaaaatcatacaaaatacccatgaagtttaagaatttatggcacttgaaatatttgcccttagacaatgttcttagtatttctgagcctcagtttttaatacatgaataagaatactttaagtattattcttccacataatgggaataagaatacttactccatgaaatgagaataagaagacttactttatgtagctactgagggagtcaagtgaggaacaattactaatgccatgacacagtgtagatgctcaatactcatcattcagtttccccttttgaacttaaggccagaaagaagtgacttcagtggtggtactaaggagagagggggtgatttagccttcgcttaacattcatcagacctcacaccaagccacaggaagcaaatatacaatctctgaaaatagggaaacctacattcaagacaaatcctgtgtgtacctcctccccttcctctcccagaaaagatggctatgtctgaatcacaaaatgtaagcggtcgcctaaaaattcagaaatcaggataaattatattttacctcattttaacaattaaaatcaatgcaaaataattcatatgagcaaaatattaaaattttaagagaatacaagatgtaatcttgcattcgtgccactcatgttctctggcctcatccttatctccacttaaccaccaactgaaggactagaaagttggcaatgacataaagcacagcttcctcatgccatcttcccatgtccccccaactttgggatagtaaacattgcctgaatttataatcctgtaatatttttaaatgttttatcagatacatatgtttcaacaatatttgttccagtttagtgtagcaggtaagactgtgggtttcagagcatttccacctggatttgaattctgtctacactaattactggatatctgaccttgggaatgttactgaagttctctgagcctcagttttctcatccaaaaaaaaaatggggacaataatagtaaatatgtcatagggctattgtgaacatatgtgagaacattaaaaatatttactgtatgacacaaaatgttttagtttgtttttatatttaaatgttattaaaaagatatttgggactcatattttcctcatgcatcatcccatccctagaatttatcttgattgttttgtgtagcagtcgtttctttgactactatgtaatcaggttaactgtccattttcctgccagagggcatttgggctgctcgaagatttttcgtttattgtgttattttgggcagtgctgctaggaacattctcctcatgtttccttttgcaaatgcctctctgtttttgatgttgcagatggattttaccttgccatggcatgaaatccaaaggctgtacccacagattccgatatttatctcttgcttgtccacacctagtaataaactttagccaaagcaaactgttgcttgttactatgagcctaaagtcgctgtgctggtccctcctgaatccttttctatgagtcgcttagtactcttgctctcaagctctggtctgtaccgagctgacagctttttttatttctaggactttattgctgttttaaagtctttccactctgaatctgtacctattcaccccagagttagttgcatttctctgtgtctctaacctgagggtcatgagtctgactttgctcagtgaaggcaaatattttcttcctctgcagtctgtgttcattttgataatgatgcttgatggggggactaagcatccccctgagaggaaagaatctcgtttggattgtaatttgtcacagtttgtcttagtttggatttctttaaaagctaagcctgaggcgaggactagagagcaactagctcatttggtagctgatcacagggagcacaagtgggaggcaggggaagtaaggaaaaacgggggaaaacaatagtgagtgtattattcagctggctactgcagtgggaaactgttgttcaatcctgtgaagacccctctgaggaatgctgtagaatgtactcataattgtccctctgaagaataagaggctggggaatatgtctctggttcctgtgcctcattaattatttctcagggacatcaggtcccctcctgtgtgttggatgagtgagtttctataactttggacaaagtcgtgaggctgaaacacagagaagcagtgggtgcttgacctggtgggctgttagcatgcccgagactctccattacagggctgatcaagccagaggtaaaccaacagagtgggcagtgtctgctacacagttccaactggatttcccaattacctagtgctatggtcttctttgacaacgtgtctcaagaaggtaacctgtagctctagcccactgctactgaatgtttcatacctggtatcatgtggattataactgtagtatttcatttttcaggtattgtagtatcgaaaagccctatagcctgttttccttagtataaattttgattaaattatgcaagtccactttaaattcacagtttgatgttatgtacttaggaggcactcaataaatagttcttaaagcaataatttttaaatgactttttgtattatgtagacacatattaactataatagagcccttcggcaggaaaactgtttcttcaaagttgcaaagtgactgacaacgatatatataactagaagcttcaagaaaaatgttaccaggggccacttttaaactagggggaaaatcgtttttcacaataagctatcccatctcctccctactgaagcctctgatctgctatgattattaaaccctcatcttttagtgcaagaaacccagcaagctgaaagggaaatgcttttcagatttaaaaaacaaaaacaaaaacaaaaataaacttaatttcttttaggttgatgttgttatactaacttgccaatcagttaaacatgtatctgtcttttaaaaatatcttattacataagaacaaaagattttaagacatacagtttcaatcataaccaaatgtgtttattacttcgaattttccacagtaacttgaagccatctatgtacccatctccaattccatcgcttccccactaccaccagagataacggtggtcgtgaaatttgctttgttttatagtcttgctacatatatatgtattactaaaagagaaatagtcttgctctgcatgcttttgaacttcgtatagttggaatcatattgcatttattcttctgtgactgtttctttcaatcagcattatgttgctaagattcatccatgtctgtgactgcagcattatgtcatattccgtcatagaaataacccacaatttatttatgcatactactgttgatggatactagggtcgtttccagttttaattcttttcctattacaaacaaggttccttgtatacatgtaggagtgggattgctgggtcacagggcccatgtatgtgccctctggtatactctttggctcctttacactgctctactgtgtaccactgggagactgacctttgtagactgtgtgtgccaggcttccatttccaggtgacttccagctctctttggctgatggtgaaggattggaaactcagggaagacacaagagtgcttctcttcctctctttgtgtttcaggcagtatctttggcaacagctgcatatgctttgatgtcccccctccaaccagataggcccactatagctgcagcttccaatgaatgatctcataacctcattcactgaattcatgcaccctgccttcttctttcctcctcctccccattccttctcctcttcctcctccccatcctcctccttctctctctctctctctctctctctctccccttctctcccactcttcttctctcctctcccttcctctccctgtactttaagggtaatagtggcttcctgtggttgctaaactctgagtcactttgtcctccacagcttgtcaactctgttcttctctcatttgtttcaattctataatttaagctttctgatttaaatatcaaatgactttttgtgtctgcttagattctgactgacatgatgtatttctaagtttccaagattatgccaaattatttttaaaattggttacaccaatttaaattctcacgaacttaaaaattctgcttgctcccaaattctaacacttgacaatgtcaaacttaacttttggctactctgttgagtataaaattgtttctagctgtggatttactttgaattgcattaatgaaaaatgagtttgggcattttttcatggttccattggcaagttttaaatgcagacaattgtttagaatacattatttttatttaataaaactcattattaaatgtatattcctttaaggctgtactttgatttagtgtaagtagtacacaatttacctcagttttccgttttatgtattcactcatttaatttagcagatatgaattaagttctacaatatactatacagagtttaatgtgaaagtaagaaatcagaacatgttatggctaggataacttgggagcacagccttttgaaactggtttagtgttaggatacacatttttgtgtttacctctctttcccaccgccagtttcaccatcattcataagatcaatgactgtggtacattacaaatataatgtgaaattgtttacaagatttagtattgttcaatcattttgcaggcactatcatggaccttcagtgtcaataaaggattcagaggttccagaaaattctaggctatatcatgccttgagaagtcctatctaataaatatatagaccacttttagagtgtaaaggaattcgtaaaatgtgtcagcttaaaatattgaaatagcgagggtgacttttcctttccaaactgttgatgaagactgcagacagggataaacattagctctgtgtggacaggatagtgtctgttgtctgagattctggtcatactggtttaatacccataattgaaagagctctaagacatggctttgtggagaaagaaagatactacttgagagaaagcaagttcatatttccttttactaataagtgttcagattcctaaaatactgtaacagtaaaaagatattttgaaactttctaagaaagtgtgttctagggcggggcgcggtggctcactcctgtaatcccagcactttggggggccgaggcaggcggatcacgaggtcaggatttcgagaccagcctggccaacatagtgaaaccccgtctctactaaaaatgcacacacagaaaaattagccaggcatggcggcgggcacctggaatcccagctactcaggaggctgaggcaggagaatcgcttggcaggagaattgggaggcggaggttgcagtgagcccagatcacaccattgcactccagcccgggtgacagtgtgagactctatctaaaaaaaataaaagaaaaagaaattgcattctaggggtgaacatccacatgtacctgggatcaatccttccacagtcatatcttcacatcataattctaaccctaaatcatcaagaaaatattatgttagacataccatacataagaagggaaagagagctgtcctacataatcattttcatgtaaacctttcatccagaagttgaggtgttctgtcatccaaaggagtagctctcagctgtctggaaaacctttttgttcagaaggacatttgttgtgctttggtttaccttgggttttattgtgccgcgtgtgtgtgtgtgcaattctcattctattaaattattgtgtgattttgatacatttatgtcagggattagaaattttagaaatagattatttctggttttctgatcaatgtgtcctgtctatgtattttgtctttgtgcaaaggaataagactaaaacacaagttatatgcctgagtctacaactgagtgttgtaaaccaaaattccaaatgaaagaaagatatggggtggatggcaggattagagaattgaaagagtgaagaacaaaaggcttgcagacatcagtaaaatatgctttcttagttaaaaatagtaagaatgttttggaatattttacattaatttcgtttcccactttttctttacttttgcacaattaatgatttagtttttgagtttcaaatatttggccaagcttatctactgattgaattcaatttcttactggatgtgtgtactgcttttttgttgcattcatggcataaattttgtggacgcatttctacaaaaaccgtggattcagcatgttgcagagtactatggcaagaaaactgagtaacagactaagctgagacttggtagaaaatatctgttctcctacaaggcttgactctctactgttacttcaagaaaatattatgttaactatatgtgttatacttaagaaggcagaaggatactcactcctctgacgtggcgagatactcctcattacccccacggaaatactatctagattgtgaactcatccatagaatgactacatatgattcattttgtgatttccctaatatgtattgagtttaaactacattgaattccctggagtttgactagaaggttgattatccagtagagtttcttgtaagaaattcttatagcagtgaactattctttatggcagataaatcctacctgtgtatactgattttctttcttagtaccatagttatactcaggttactttttttttttttttttttttttgctcatatagacaagactacataatcctttttagaaagggccaatatcctatttggaataaaaacaaaacagttagatggtaccagggtcaccttaaattaacttatcagactatcaaccaaatcgaaatatgatttcagatgtaattaacccatttgcctagtgagatgcaaaggtgtgaggatttcttgaacacatctttctcttatgtagcaaatatcaacctcctgataccttttgtagtcagttcacataccatgacaatacatcctaaattttcaggtgtgatctaaccagcataggttcacataattggcatgacacggaatttttaaaatatcaactacctcaggaactttattcatgtgaatctggaagatcctttttggtatttgagccctttcatagattcagatgtcaaagtatttttagaatgggtctgtaaggcatcattattttgtaattataatcttattgattgacagcaaatgctgtgttccatgaaaatgttgcattgaagtgatcccggttagtgctaaagacagactgcttagatctaaagtctcatgagaagaaagaaagaacttaaaatcattttaaattcaccaatatgacgatacaggatctctcataaaatgctgaaaggttgtttttgctgccagacttttagcacttccgttttacgttcaaatgttgtaaaggttgattactcataagttaaaatgtttggtgcaaaatgtactttaaaaatattttcagtgttttttggaaattgtagacatttgattttgaaaagtaggccagaaatttggaagactacaagccatatgatggctgatatttcccatggaaaatataatatgcagctgtgctctgctgcatggtagaacaggagattaaaatatgagaaattataataccgtttgatgatgatattaatgtcactgaatcaaataaagtatgtgatatatcataagttaatagaacaacacttaattattgattagagcctacatcacattttaaattatcggcatgtttggtcttgcaaagggtcaagggtgactcgtagcaacagaactattctcctttcaaaaagttagcagaaagttaatatcaaattctatgaggtagagagggatttgggctgaggtaggtcaggaggaacgtaaagagatgtgtcatgtgtagatttgtgagctgtgggcacctgattttgtgtttaacagtatttacgaccaagataagtgaatgaagagctatgttcttatgaaccttaagtttattttgctaaaataagtaagaaaattcaaattcaaattaagctatatagtcttgcaaatttcaggtctctgaggggtgtgcattaataagtattcaaaagtattttgtcatttaattactattatatgaatttttatgtaattgaattattcttgaatgttgagaaactgtctttactaggctaaaaattcccttagtgatctcgttacccaattcctttgtgttccactctcagtgtctgaattgtcaccaatatgtggagtccaaattatgaaatacaaagctttaccagaattctgatgattttgaaggaagaaaattacagcaaattttgatcaattctctcctattagtgattaattcaatgaaccgcttgaatttcttatttcctcgtagaactgtatgtacatgaaggatagatacaatatttagtacaatctatagtgagatatgaagggaaggagattatgagaaaagaataaaactttattataaaaatgcttgttcataaagatttgacacaaaatcaatatgataagttttcagaaaatcaaacaatgaatttcgtatgaaacctcacattggcaaagcagttatgtgaataccaatattttttaaatctaaaacaaagcattttgaagtagtttcatgaataatgtactgaacctgtttcacgcaatgaaatgaacatcacagtgagaaaattattccacaattgtaaagttaagtgaagcttgcattataaggccaataatactcaatagggtattttctcatgaatttacactatagaatgtttttattctggaatttggatgatatcatagtcattcaacaaatacagagactaagtgatttttaaaatctttcaggaaattagttctttaatttcatctacatgtatgtaaaataaccaaacctatgtcttatgcatataatgtcattctaatatattgttcatgatcataatatttatatagaatccattttgcttggccgattgatttggcttggcctacaaattagtacagtccctctcaactttgacacttctgtgtaccatcagctccttcctggagtactgaaatagcatcctaactgctctctctcatgtagtcttgaccccatctataaatcctaatttcagcatttggagcaaccttttagaaagatcaattaaatcatctcacctcttcattaaaacgcctctcattctaccaagagtaaattccaaaccttttaaccttgacctacataactggaccatgcctccctcgcccatttcaattcagctttgctcttgtagctccaggcaagctagctctgtcttagttcttgcatgtaataagctttcaagtccctcggtgtctacttatttactgttccctctgtattagtccattctggcattgctgtaaagaaatacctgacactggataatttataaagaaaagacgtttagttggttcacggttctgcaggctgttcaggaagcatagcagcttctgcttctggggcggcctcaggaagcttctaatcatggcagaaggcagacggggagcgaggtgactcagacggtgggagcaagggcaagagagacagcaagtggggaggtgctgcacacttttaaacaaccagatctcgtgagagcccactatcgcgagaacagcatcaaggggatggtgctacaccattaatgagaaacaccgtgatccaatcacctgccaccaggccccacctctaacattagggattacaattcaacatgagatttcgtggggacatgaatttaaaccatatcactatctgactggaatgtgctttgctcctgcttctacttccgttttctgagcaatcagacagttattcattaactcattcattcattcactcactcatttgttcatttatgtattaaattattcagtgattctcaactctgggtggttttgccgtccaggggttatttcaccatgtccggagagattcctagtggcataactaaaagaagagatgtttgctactggtgtctagtgggtagagaccagggatgttgctaaacatgtaataatgttcaggtcaacccaccataataaagaatcatcttgtgcaaaatctcagtagcaccaagattgagaatctctgcaatacgtcaacaacccttctaggtgccaggaatatgacagtgaaccaaatgaatatggtctaaactttcacaaactaatccattaaggagaagatagtcaataagctggctaacaaacaattaaatgtatactttcaaattatgttgggtgctctcatggacaaggggacaagagagtggccagtgaaacctaatttagagcaggtggtgttgggggaggtggtgtttatgctaagacccaaagaatgaaagaaagactcagccccaacttatatatatagtaaacatttattgaatatcaatagcaaaaagttgcatttttctcaaccatgtctttttatggtaactggaaattgttcaaattattttttagaatcttttaatcatagattctttgctaaggggattagtctagcatttttctcttgtgagcaattaagttctcaccaagttagtgaatcctatgtcttatgtacttcctacttattactatgaaattatctaaaaaatgctcatagggttcctaatgtagttgaaaagcaaactgttgctgcatctctaatcagtaacaaaacttgtatttctgtcgcaaaataatgtaaaattttatagtactttttacatatttatttaaaacaattttaagtaagattgtttctttgtggaaggtcatatggtcccaatatagggatgtgtacagaaatacatatatacatacaacaacacaatgttaaacctagcaaaagagtggagtctctttcttttatttttcttactttttgagcaacgagacaagcaacatattatgcctagtcacttgaatcatacaccattaaaacattatgggctgagtgcagtggctcatgcctgtaatcccagcactttggaaggccaaggcaggtggattacctgaggtcaggagttcaagaccagcctggccaacatggtgaaaccctgtctctaccaaaaatacaaaaattagccgggcgtgtggtggtggatgcctgtaatcccagctacttgggaggctgaggcaggagaattgcttgagcccgggaggcggaggttgcagtgagcagagatccgccattgcactccagcctgggtgacagagcgagactccatctccaaaaaaagaaaagaaaatatgaaaagaaccatttttaatgtcaactactgctttgatgctaatgtctgtcagttcagtgtctatgacttaccctttattctgctcaaaaccttcttgaattttccatttgaatatcccacaggctcttgaccccacttatccaaaattaaacctatcttcctctctactacacctcttcttataatctttctcttgctatttctaaacatttagtgggccaaataaataccctaggagacatgacttgaaaggggtatgaagtttagataatgttcggcttcttgatctgatactggttaaatgggtgcattacatttgtgaaaacttattgagtcacttatgacttacagattttctctatatattttatattttaagaaaaaagattacatataaattctagaagccaagctacacctttccctcttattcatccagcacatttactgagacagctagattttcataatgactgtccattgttgaatatttgctatatctttgatattgttatccattattaacttccttacctggtttgacagttgaaaatttctgtggtgcagctattattatttccatttcacatatgagcaaaaagagacttagagtggttaagtaacttgtctaagttcacacaacaacaaagtggcaggagtagagtttgaattcgagtcaatatttataatcactatgatatcttgcttctcgtgttccagtcgcattaaaactatgaatgccactcccactccttatccatccttactacctggcttcactttagatcttcaggtcttctttcctatattataatgataatatcataagaaatccagtgcagtttagtctattccaaaatcagtctaaatactgccaggattagtgttcattccacaatataaatctgattgtgtagtttacttaaaatccattaacacagccgttagcaaccttagctacatgtgaaaatcaccaggctccacccaagataaattaaatcagaatctctgggtatgagggactgggagtgagcattttaagaaagctccctgggtaactgtaatgctcagctaggcttggaaaccaatgctttaacgtttccctacagcttttattataaaaataaacccctcagcattgcacaaaatgccctttgtaatttggtttttgccttcctctacctcgcctcctctgctgtaattcccttcttctcccactttttccccaccctacctacatacatttcattgcaattattcaaaagtctttgtttcttctgaagagttatgatttttataccatacccttacacataccagtcttcccctctaaatgcttagttacattatctttgtacttaatccttttagttgctgataataaatgaaaatttctttttagtttctttttttttttttttttttttgagactgagtctcactctgtcgcccaggctgggctgcaacctgggctgcaacctccgcctcccgggttcaagggattctcttgcctcagcctcctgagtagctgggactacaggcatgagccaccaagcccagctaatttttgtatttttagtagagatggggtttcatcatgttggccaggctggtctcaaactcctgacctcgggtgatccacccgccttggcctcccaaagtgctgggattacaggtgtgaaccaccgcacctggccaaatttctttatagtttcttgacttgtttttaatttagaaaatttcccacgtatatagacaccatacaatttataatgtaaagctgttttcctatatcaatcatgttttaccttttttctctttctcctatatatgctgcttcctggaagatctaggagctgacaagtgtctttttatcttgctttgcaaatctaatcttttgccatttctttttatagaaatgaaagcttgtatcatgcatactaaagatggcttcttctttgggctgtagggccatttaatgagttatattgaactgaatgctttataagagttcaaattagtacattgggatactcctatgccagggatggattaatatatctgtccacatatatacacaaaaatgtgtgttgctaatttccaaattagagaatacttattttgaattatcagtatctatgacatattttgcatgtggtatatatttggttaattaaactgagttaccacttgttttatcaaaatttggtgtctttctaaatatatcatgaatatttttcttctaatgcacctcgctttctgctggaactatagaaacactttgtaaatttttacttgtgaccactcgaacatttacaggacattttacctgaaaattttttctgagtcagtgaagaaaatgtccatgtttctgcgtgtgtgtgtgtgtgtgtgtgtgtgtgtgtgtgtgtgtttgtgtgtgtgtgatgcttgcttatgaggaatttattttggctatggttctttattttgctattgcactcttaacattcgtatgatatgtattattaccctataaatacttacacaatatattcttacaaaaattaatacaaagattggccaaaatgtaatagcatatgtttttgtaaatagaatatccatatacagtcataataaaactgaagagcgattttatacttttccataaagccaaagattaagggtgtaatcactgcttataatttactaggaaactataaaacagataaaagtagatgaaaggatattacaaatatctcaataagtcgtcctccgcaactgaccccttgctttacacatgttcagacactctatactaaactctgtttatttttctattttataattttctatatgatcgtaattcagcgttttcctataatattattagtagtgctaccaacagatattacattttatgaaaaattttaaaaagggcacatgttgcataaaactaggttttgaaacagctgcttataatgctgatatttagcacatgactaggtggaatatggactttttaatgaatattttttcaaagttaggtaatttctcatcagtcagtttcaaaagcaaagttaaaatttgtgtttcaaaaaactgggtatgtttgaaaattgtatttaataatggattttgagagttctcaatagcaaattgcttggctgactgtagtttaagaagtaataattttgaagagaagttgaatgcaggtactttcaaagtgttgaaatttttaaagaagaaaattaaccttttcagactgtacacttgttcatcttttatattcttttccctttaaaaaagaattgtagtaagaagggagattaccttctgtcattgatacaaattttccacagtataaatgctgtttatcacatttgtataatatacacttcctatcaattttaaaaattacatgttactactatttaactctgacttaattattttaaatataaaataattcattcttttataaataatcaaaactatagttttacttttctttcaaaatataccactgactacattacagattagattttttttagtataccaaacatattttcatcttttggagttattggaagagtagctgcttactgccttacattttagatttctctatataacaagcattttcatcattttggcttattcgagtaattcttaataaataataatacaatatttacaaatgagatgtcatttgcaattttaacacttcataattttaacaaaatatctttactttgagttttttactttccttttggtgtgacattttgacctccaatgtgatcttcatttaaaggaaatatcaacgaaaattccttttttttcatttgctatagatgtacatataagatttacatgtgtaaggaatatagagcaataatgaattgagctattcctcataatcacttcacttaagaaatagggggctgggtgtggtggcttgtgcttgtaatcccagagttttgggaggctgaggtggtaggattgcttgtgtccaggagtttgagtccagcctaaccaacatatcaagacattaagtctatgaaaaaattaaaaaattatctgggcatagtggcatgcacctatagtcctagctactcaggaggctgaggcagttgaatggcttgagcccagaaattcaaggttagactgagagctatgatagtgccactaaacttcagcctgggaaacagagtgagggcccttctcttaaagaaaaattgactagaatatgactaatactctagaagccctcctccacatgccacccttcccaaatgcaccactattctctcttcccaattttcatttttgtatttattattcctattcataccaacacaattttaccagatgtgtatgtattttcagcaaatatttttagtttattatgcacttaattgacactatggaagaacagcttttaagatattattccaacttagggaattttaaggaaataagacctttgtatataaaaagttaaataggaataccgatttgcttttgattagtgttaaatcacataagtttaaatttgtaggagatcatagagatcagaaagcccagtggttcacaaactttcttttttttatcaacaaaacctcttttaaaaatatatagcataaggaagacggaaccataaaactgaaattacagcagctcaactgaattgtgagtttcaactgaactcaatttcaaacccacaaataagtcaaactcttactttactgagaatatatttggaccacacagagtttaaaaaacatgtttaaatttatttagcttatttataccagaaccaatataagaatccataacattctgcattagaattaagtacaaacactttttctttctttctttttctttttctttcttttttttttttttttgagacggagtcttgctctgttgtccaggctggagtgcagtgacgcgatctcggctcactgcaacctctgcctcccaggttcaagtgattcttctgcctcagcctcctgagtagctgggactacaggcacgtgccaccacgaccagctaatttttgtatttttagtagcgacggggtttcaccatgttggtcaggatggtctcgatctcttgatctcgtgatccgcccgcctcagcctcccaaagtgctgtgattgcaggcgtgagccaccgcacccggccgtagaattaagtacaaacactttctatgatattatactaaattaaaaacaggaactcaaaatgatacaaactgaactgaaataaaataaaataatacagtgaatggagtccacaattaaaatacctgcaaggacctgaaagggaatggaaataggtgaagcaaagatctaaatgcatacggacattgtgtaaattggaaagaatactggcaaatggcacgcctgtgcccagtctaaaatgggcaactgctaatcaattcagtctagcagtgtccatgtcagaatgtagagctatttttggccatatattttatttttcaagaggaacttaagaatctggagttgtatgtaaaacatcccagtgcactatatatttgcctcataagttgagcacttttttttatgtgtgcatgttgtctactggtgaatcccaagcacttggaacagtgcctgatatatagtaggcagtgatgtatatttggtgggtaactggaaaaaggttttccaattaaaaattctgtgcaagcctgaggtaggagttgggcaggacttatttcccattcccagaggataaagtgaagaaactggcaggtaccagcaggcagcgaccaacggaagtgagaaaaacagcagaaaccagcagatggcaacaaaagtgatccccagcagccctcattgcatattagcagaagccactcccaccagcaccatgacagtttacaaaggacatggcaataacccagaagttaccacccctttcctagaaagttctaaataacctgtctctcaatttgcattaatctgccacttaatttacatgtaattgaaagtgggtataaatggatataaatacagtagccagcagcccataccctgccaactttggaggcactgcctatgagttgtccctatttcacaaagcgcagtaatgttcactaaaacatagctgtttaacgccactggctcgcccttgaattctttcctaggcaaagccaagaatcctcccaggccaagccctgattttggggcttaacctgtcctgtatcaaactagccaaatgtatctcaggcctgaattagatcaatggctaccagttcaaatcttttgttttagatattagagaggcaggaagtgactctctactgtgtagcatgatactcagagcccaggaacttcttcagaatcccagtttgacttccaaaacgccagtgtcttgcttttatttactcttgtgggtggcagtaagggaagggagcatatctccttagcaaaacatctcatcagaacacggtccatagcacaaattattaattaaagacttacgtggaggctcaaatatagagccaaagcataaccatttaacaattatccttcaaagcaattttattcttggcttttggtggaaaaaactcttaaaaataaaatgataattctacatatgggatttgtgatgctatttagcaaggatatgctttattgcctgacatcccctttattttggcagaatactatgagattctcattacgtttccatttgctgcggaaagtggagaaaagttcagagggggaagactaattaaaaaaatggttgtctactaatccattgaactaaggcttcttaacagtcatgctcttcttaatagtatgaacacacattttgtattgattgcagagaataaagaaaaagaaatgacttgttttgaacttcaaaatggaaaaaatgaatacaaaatccagataagcctttgggcataccaactttttcgacttgtattatataacaacagttggcaaatgatttcaagttgctaaagcatagaaaatgatatttatttgatgaaagctaataaatcagacagaacaattaatggataatttggattgaacaagtatgaaagattccaccaataagaaccctcctacctaaaactatgaggtttttaaatgaaagactctcctaatgtcatagattttctctacctgtgctttatctgaaaataaaaatcacagcttttcccttcacctcttcattctctactcctccttatatttcccctttccttcttccttccttctccttcctttactctttgttctttttattcctgtttgttctgattacctgtgatgttttctaaaaacattaaaattttggtcaccattaatattttttacaatgaattaagaaatttatctcagaaactggatttgaaccaaagccttgttttgaacttctaataagtagactgaggaacaagcacgattttaagggcatatttaataggcaaaataaaaaaaacgcataaaatgcccagtcgttgatgaaaaaaatatatttttgtaattgctgttattcaggtgcttgaaggcccatgttaaagtatcactggagaagataaaaagcatacttcctcaatgtgaaaaccctcaaaagaaagggctataaacactttgtcctgaatatttgttgtttcaattgctgacgtttaacttttcatctgacagcaattcaagttctgcgtaccacagtgttgttgaatctttgaatctgaaaaatattttccttgcagctgtgataataatgtatctcctgataatgcatttaatgtggcaaagacacttttcttaaacacagtgaaaactaagtgttcattttgtcattgtaaaatgagacatgtttagttgctccaaattttaacttgggtaaccttgagacatagttgcacatttaacatcctatattttgcttgtcttgcagtcaagtgaattatcttagttactggagtgttacgtgacaccaattgttttgttaccactgctttaaaaatagctctatccctagaccccatcagtagtgtgtcttttagggccccgatttttttctaatctataggttagccctcaaggcaacgtggcctctttctgtttacttctcattattcctgtaattccaattctacatgtgactctttgctttattttaaaacagttgtgcattgctgatgagccttgaagtcaccaggggtggctggtgtcaatagtgagtctgtacatggctatttttatccataaagcagtttactttctgtatgatgaaaggcgttaaagtaaaacctgcctcctattataccctaggggtgtaatcaagagggatttgatcatagcataccaattaagcaggctacagcagactgctctgggttgtactaaggagtagggtgttctccacagatttttgaaccctttattgcaaaagcatcagggcacagcacatctaattcttttcatcgcacagctgtgtacataaacctctgtatacagtttctgctcagaggctgtgctcttagatttaatttttcttataagtcattacagccgtgatcattcatttaaacctcggcaagataagcattactagttcccagtaaactagatgatctcttcctctagactgtattttctcttatgaacaattataagattacaagactagcaatgttgcttatttacactacactacacacacacacacacacacacacacacacacgttcattccaagccagcagccagctcagcatccttgaaagctctcaacctcagccgaatatataaatatcagaattctctctaccaccctcaattagaaaatgttccagttctgcttttaaacttccactccaattcttcttgctaaggcctggaagcctcaaggtttcttgtattgccttatatacacctggattattcctctctgttgaaaactatgtcccattggaatgggagtgtctgaccagctggtgcccaagaatgctctcagaaaacgatcttccacaagccagagccaaaacccaaacccttgacccttatcaaccttgacgcccaaaactccaggtgtggattagcacagtaacccgcaaacccactcctacacgaaggaagatttttctagaacaactacagctctccttttatatttttgggtaattcagttatgatgaactgaaccagaagtataaagtatttgctcagttcagttcttaatctttgtcatggtattacaatactaaaccacttgctttgtcactttcatatagctcataaaagaaaatattactgtataaaatagattctgtagtccttcacttgttgttatggactgactattcgtgtttgccccaaattcatatgctgaagccctaacccccaatgggacgatatttggagatggaacctttgggaattaattagggtaagataagcacatgcaggtggggctctgatccggtggcccgtgtaaagaaaacaccagagagcttgctcttgctttgccatgtgaggacacaggagaaggttgttgtttacatatcaggaggagagccctctccagaacttgaacacgctggaacactgacctcggacttaaagcctccagaactgtgagaaaataaatttctgttgtttaagctgcccagtctatggtatcttgttacagcaggctgaaatgagtaagacacttgtattgtccctgcggttgacatctgactctgtaaaaacacccatgcatacacacacgtacacacaaaacaacaacataaccagtaagataggtaatcaagtatatggtaaatgcacctgattgcaataatgtgcgcatacccttagaatgaccctgtactgcagacacacctgaatgtgttttccgagctacggaatctgggagtagcccagcaagagagcccttccttgtctatgaggaacatctgagccccaagtgcatcccgtggaacacgggccatacatacagcggattgaggccccgagttttgggttggatgaaggttgccaggtgaacgtcattaagggcagagggttaagtaaaaatgctatataaactgcatgctgcccgcaagcagcgttggtttgcccgctcatcccaccgccgccatcactaccactgtgctgcgaggctatcttgtccagtctgccaccactggatcgtttctacaggtaaggcacttctcctgtccagcccaccactactgaattccctcccctgtatgtaaacctctaataaaacccaatgcctcgtttgctggctatgggtttcttcctcagtctcttgaacctgatgccttcgctattgagggttataggggttcagtacaacatcatgatgtgaacaaacgcgtttatttgggcagatgtattggtcagctctcaaaacaataatatcaagtaataatcattacctccaacttaatggttttaaatagcattaattctcatggtcatgcggggtttggctgacctaagttgatctagatttggttctgcatcaggctggtagttgctaggcttggctttcagcggcaggtttggtttggatttctttgatgtgtcacgtccagaggcacacactggaatggcaccggccacccagtgcatgttttcataggttgtcactagatagcaagcccaaacatgccagcccatctcaaggctctgctcctgtcatgttttcttaacaccccgttgaccaaaggctatcacatttcccaccataggctagatatgccatcctattaagtaggaatgagaaagtggggaccaataaatcaacctacagtaggaaaagtaggggattatttagtagcacaaacagatgagtttcagtgggcttgctgcttttttgtggatatggaagaaatacctaaaaaaaaaaatttccagctccactacaatatttaagaaaaaacttaggtgtgttcatagtttactactttgcttaataaccccactgtttatcacagcaaatttaatcacctctgaggggttttaatggctttgataagacaaagagtaaattactgaggaggaagacggtcactttcacatcctgagagatgctaactgtgcaaggtaattcacatatatcttgtaaacatgtttgcaaacatatataggagataggtggtattctcattttttaaggaaagaaatggaagacatgagagaatgagtaatatgtttaagaggacacagctggaaactggtataatctggctctaaatacgggcttttgtgttacattgaacagagataaattcagcttatgttaaggaagcatggggtaaaaaggtcaagaaactgaacaactgaataaccaaataagtaggcgaaaccatttggttactcagttgtctgaccaaccgaataatcaaaacaaaaatgtcacattagaaaactacgatcagtgtaattttatgaataattgaactattgagaccatagtgtagcagctgatctatcacgtcatgggattccatcattcattctcatgaattaactactctcagtccttgcttttagcattacctctactccctaatgatacatgatttttactctaacataaacttcccaggagaaaatgtctgataaatatcataaaatcatgaaaatatctgataaagtcatcatcctgcatcatgtgtgggagacttaagtttgtaactcttcccattcctttaagttggttttcagccttgcttacacgatcattgtggccagagagacagaatgtgccaagcgtgtaggcctgagctgggaaacaatgtcaataagtaatacagtataggggatgagaagtttgccaaataatacttggtgtgtaatgttatgaaagaaagggggcattagaggccgggtggctcacgcctgtaatcccagcacttcgggaggctgaggcgggtggatcacgaggtctaagagatcaagaccatcctggccaacatggtgaaaccccgtctctactacaaatacaaaaaaaaattagccgggtgtggtggcaggtgcctgtaatcccagctatttgggaggccgaggcatgacaatcgcttgaacccaggaggcagaggttgcagtgagccgagatcgcaccgttgcgctccagcctgggcaaaaagagtagaactctgtctcaaagaaacaaaaaacaaaaaacgaaaacaaacaaaacaacatggcgtggggggcatcagaaacacacaatggtacagatttaaaagctcctcgggtgatgctaatgtgtagccagggctgaaaacctaaaagaagaatgtgcagtaatgttgccagtactggaaggaagtgtctgagttttgtctagtgactgacagaaggctatgaaactgtaacagttgtaaggggttgagggaaagccgaggccagatcatgtggatcatgtgcaaattgtaggtaaaatgtaaagctgtgagttctgtggcctcactgaggaagcatttctctgcttttcaggaagtaacttggagttgagtgctctatgatttccaagttgtcagctaacacattgaataactgatgaattatggttctgtggccttcatttctgtgtcacgtggctatactgttcattggcatatgcaggcagtaacccccaaactatgacgcgagaggatggcaggattccaggtctgaagagaaaaaatgattaggctggggaagaatgatttgaggaacctcaaatcagactatggcagcaactactaggtgtagggcttcatgccatccagccttggagttgtcagttttctattaatctttgctaacaataaaatactaatgggtacataatgtagtgatttacagatgatagactctccttatgttttcattttgtctcaacagagtccagcatatttcatccaaattttactgatcagagaattgaggtacagacagaccatgaaggtcatgacagttggaaagtgttggagtagaataaggaagcctgatttttctcatttgtcctacatcgctttattagattgtcttctccagccttacctccccgccttataattcttgattttcatgaaacctattaaagggaaagaaaaggaaaactagaaaatttaatttagatcacttttaaaaatcactttgcatcttggactgttgtcataagttataggattaaatcctaatgattctaatgttgttaggccatcttaatttatatgatccacttacctctcagtcttctctcactggctcactcacctgccctctgtatatgaggggattgagaaaagtctgtttttcattatgtgtagatacacagactggtgtgtatgtagcaggaataaatgttcgcaaaactcagatgtggaagaagtaactctgaatttttgccctatttttgaactgtactccaggccagtgctgtccaaaagaaatataagctatatatgtaatttaaactttttgagtagccactttaaaaagtgaaaataaacaggtgacattaatgttttatttagctaaaatatttcaacatgtaatcaaaaaagacttaatgagacattttacgttagtgaaaagaatgtactaaatcattaaggttggaggatattttacatttacagcacatctgaattcagttgccatattttcatgggttaaagtaaacttgttctcccaaaccaatgaagttatggttaatggaagaatattaaaaactgtttgttttcaatataaataaaattgaagcaaaaataaagcaaaatgaaaatttggcttcctcagttatgctagtcccatttcaaatgttcagtagccacatataactagtggctatcttactggacaacataaccccagatcatgataaaacgttctgatttcccgaatttcttttttttagacaatctgggatgtttcgccttcttaccaaagaaacaaaaaggtgctggtactttttgtttgcttgtttttcagcagttgccattgaaatgtgtttcttttggagttggataggaaaaacctagattcttcctccaaggtgtagtctcaactgtgccccaggcatcactgtttatgatggattaagggtgtggcttttcccagataatgagtccccctcccccaccccccacaggccttaatatctacagctcctgtcaatagactggcctttccttccccgcgaaaagtttgagtcctttaagaatctaggtctaaggttaatttcaacgaaaggtttattttctctttctgcgaggacctatggaactacccagaacatataaagcagtccacaaggctcttcaacagcttcgtaaccgggcactgctagttcagaaactcactgacttctgaatgtccatttcacatttgcaggctgcttctctgagtcctgagctcttgtctcaagatgacttggctcttaattgttgtctgatttattaccggtttgctttgcagtttaggtgctggacaatgattcttagaaatccccacataaggatctacatgcagtggcagtgaatctcaataactgccttttcttgaatctgaacttaatttatatataaagcctactttccggtagatcctgcatatttcatctcagccaatttaggactgagatgccccccctttctctggggttttgtcttaaatttctggaggggacctgattgtcacgcccctccgagtgaagagaccaccaaacaggctttgtgtgagcaacaaggctgtttatttcacctgggtgcaggtgggctgagtctgaaaaaggagtcagccaagggtggtgggattatcattagttcttacaggttttgggataggcggtggagttaggagcgatgttttgcgagcagggggtggatctcacaaagtacattctcaagggtggggagaatgacaaagaaccttcttaagggtgggggagattacaaagtacattgatcagttagggtggggcagaaacaaatcacaatggtggaatgtcatcagttaaggctattttcactcttttgtggatcttcagttgcttcaggccatctggatgtataagggcaggtcacaggggatatgatggcttagctcagagtcctgacactgatacagtgccaggatttgaaggcgggtgtggcttacctgatttcatgtacaattcatcccatagggaccttgttccttggcctcaagttgtaggccctttcatatctctgtacggtcaagaaacatggtggttcccttgtcattcttcatcctccaaaaacccattgagcactgtgtttgctggaggcatgtgggaaattattctactgtaccctatatcctgctgaagtgcctgggtactgggtggctagctcatgtccatttgctaagacacatgctcacgattcttgcctgggtctgacataactttggagtcttgttgcattcctgggctggactctggaatgggacccaattacttctgcacctggatacccccaaccttctctgttgtggtggcggttctttcaccatcccctcctctcaggaacacactcttgtttctactttacattctccatccagtccaggaaaatagtatctaggctcagagacggagaaaatagtgtctatatttcacatttttttccaaaaaaaaaaattataattttccgtgcctggacttgagaatttgaaaactccaaaatcctccaggttcaaccacattgttcccaattacaggattttcttattaaagttgaatagtgttccattgtgtgtatattccacatttttgaatccgttcatctgttgatggttacttaggttgattccatatcttgtctaatgtgaatactgccacaataaacacgggtgtgcagatatctacttgatatactgatgtcatttccttaggtatgtacccagtagtgagattgctggattgtatggtagttctatttttatttttttttgaagaacttcctgctgttttccataatggctgtacctatttatgttcccattaagggtccaaggtttccctcttttccatattctcaccaacactagttatcctttgtctttttgagaatagccattctgacaggtgtggggtgatagcatattgttttaatttgcagttacctgactaatgataagcattttgtcatatacctgttgtccatttgtttcccttaagacatgctcgttgagacatggacacggggaggggaacatgacagaccggagcctgtgggggtgggggcgtagggagcaaggggagggagagcattaggacaaatacctaatgcacacaggacttaaaacctagatgacgggttgatagatgcagcaaaccaccatggcacatgtatacctatgtaagaagcctgcacgttctgcacatgtatcccagaacttaaaaaaaataaaaaataaaaattcagttccttaatcacagttgccactgtgattttactttgtcatattttaaaagcttttttatttcaaaaaaaaagtctgttgaggtcctttgcccatatttaattgggttgttgtattgctattgagtttaaggtttcttatatatttttggatattaatcagagtgaagggacaactcatggagcaggagaaaatatttgtataccatatacctgaaaagggattatttccttggctgtgcagaagctgtttaggttgatgcaacttcatttgtctatttttatttttgttgcctatgctcttgggttcatatccaaaaaatccttgcccagaccaatgtcataagcttttagttgatgtttttttttttttttttttttttttttttttgagacagtcttgctttgtcacccaggctggaatgcaatggtgcggtctaggctcacagcaacctccaccttccgggctccagtgattctcctgcctcagcctcctgagtagctgggactacaggcgctcaccacaacgaccggctaatttttgtatttttagtagagacggggtttcgccatgtttgccaggctggtctcaaacccctgacctcatgatctgcccgcctcaacctcccaaagtactgggattacaggcatgagccacctctcatagtccatgttttcttctagtagttttagtttcaggttttacctgtaagtctttaatccattttgagtcgattcttgtatataacagataagggtccaattttctttttatttatttattttttttgagatggattcttgctctgtcatccaggctggagtgcagtgatgggatctcggctcactgcaagctccgcctcccgggttcacaccattctcctgcctcagcctcccaagtagctgggactacaggctcctgtcagcacgcccggctaattttttgtatttttagtagagacggggtttcaccgtgttagccaggatggtctcgatctcctgacctcgtgatctgcccgcctcagcctcccaaagtgctgggattacaggtgtgagccaccatgcccagctgtaagggtccaattattaatattcccaattgaatggaagaagtaaaaggaaacaaaattaaccatattctcacttaaagtcattgttatcattttggcatatttcattgggttcctttttacccgaaatgagggttttctgctatttatttagatgtgatcgtgctatatttatgacttttcacccttttttactatcacataagtgattttaggttattatagacacactttaaatgttcacataatgaccacttattctaaagttaggcatttagttttttatttttgttgttctaaataacccagtagaccattttgtttccttttagacagcttccagcgcatgaaattattaggtcaaaggatattacctttttttttgagacggagtcttgctctgtcgcccaggctggagtgcagtggcgcgatctcggctcactgcaagcttcgcctcctgggttcacgccattctcctgcctcagcctcccgagtagctgggaccacaggcgcctgccaccacgcctggctaactttttgtatttttagtagagacggggtttcaccgtgttcgccaggatggtctcgatctcctgaccttgtaatcttcccacctcggcctcccaaagtgctgggattacaggcttgagccaccgtgcccagccaggatattaacattttttaaagggtctttatatgtatcgcaaaaatacttagcaaaattattattattattattttttaccagtttacactgcccaccaagaagctataaggacacctaaattgtcacataaaactgtgtatggataaatatctctattttataaaccacttggtataaccaaaatcctgcttttgagatattaaattttgaagctaacattcttagcatgtttttaaaataatactgacttcatgagctaatacccataatgataaaatgattttatattccaggaaagctgccatgtgggattgaatgttttatatatgatacacttttatctacatatgttgttatacagtcattggtacctttttattagatgaatttatttcatattcagtttccactgaattgtattcagcttgactacaaattagtcaagcagaataagaatgtgagttttattgtgactaatatatatttggagtctagatttggagagacaaggggtgagtaaaactgtgtgcctactacctgaaaggaaaggttttttttttttttttttttttccccctcaagggaaacaattacggagactgcccaggcatttaatattttattgaaatattctaaaccctcaaatttcgcttctacattttatgtgatgcatcagaaaaacactattttatttgttttataattctccaatagggaaatttcaacacattgtaagtttctttatttaacaacatcatctagcttttaataactgactttcatacacatttttaaaagcaggctaatcgttatagcttaatatatttttcatgagatttagtgataacatgatcacttataccagtagtttatctcctgaatcattttaaaaagtaatgtgcatgttttctttatatttatatacaattgggaagcttaatatttatgaaaatatgattgacttttttttgtcatttctcttcaaagccttaggctttgcagttatcagtagtgcagttccaagatgcaaagtcataaacttacctttcattctctttagtaggcttaatattttgaatctagccataggaagcagcctgaaacctctaatcgaaatcaaagataacaccacaggggtacaatatctctaatttgtcttggaatgatgcggtagcttcccttgactgctgtgattaaattcattctggtttgttcagttaatgagattagcacatcttaacccataggaaatattgtctttatgggcctatgactctgaacagattagcatcatgatcagaaaaataatttttaataaatgattacgtgtgagtggtgctaggctaggatccctacaaatctggcaagagcatattccttgaccttcagcattatatgactttataagacacagcattttctcaggcatgggtataaatacagttaaatatgtactataaaactaaagaacagcctgaaatttaagaactacaagaatttgtgcttgtcattaagctggagataaagttaacatcctgagaagatgtaaaggcgacagtgatacacttctccttgtttggtaggatcatttccacacttgtctgtacttggaattgtaaggtgatgagtcccttaatgatttcttattgcaagtttgaacctagtgtatttcatggtaatagactaaggggaatgagtatatgaaatgagttccagtgtattgatgaaacttagagttgcgtagagtggagcatagcttagtagaaacttgagcaagttactgtagcacatggtcctggttccaattccagcaacatctgttagttttaggacttggtgcaacttgttcaaattttctgtcagactctccattggtttaaaaaataaaattcaaaatattgacaaatattgccttcctgaattttttggtgaatattaagttagatgatgtatataaagtgcctggcccatagtaagggctcaataaaagtagctgttggtaccgcttttaactaattgttgttaaattgattggttaattatatatttccctgccacttaactgtcactcaacagcttttcctcatttcctgcctacctgattggaaatcattatgttgaatatgtctagaattatcactgggcctgctgtattccctgggtggtatgtttgtataggttgaaccactaaagaaaatcttttcggatgagttactttcctatgtcaccctactatttcctagtgggaactttaagttccttcagtctggggtcaagactagtcttagtataggggacattgggaatattgaggatggcatgtttaagtaacattgtatgtattggtcaagaaaaaacaggcaagggatagagtacatcaaaaccagaaaacctatgtacttacctttccatttctgtctttattagatatgttgagtttatttcaagtgcctctatagaacatctacagaacattaatattaagaatatcatgaaaagggatacatttttaagagcctaaattttggataaaatggaagtcattttcttttttttttttttttttttttttttttgaaacagagtcttgctctgtcacccaggctggagtgcagtggcatgatctcggctcactgcaacctctgcctcccgggttcacgccattctcctgcctcagcctcccaagtagctgggactacaggtgcccgccaccatgcccggctaattttttgtatttttagtagagacggggtttcaccgtgttagccagggtggtctcgaactcctgacctcgtgatccacctggctcggcctcccaaagtgcggggattacaggcgtgagccaccgcgcctggccatggaagccattttctaacaacaaatttaatttgtgaaaagctggtagcatgttaactctagaatgacaattttttaaaaggaaaattccaaagttaaagggaaaaaatattggggtagtgccagctagtatcaggatttatactttaaaaatgcataagaaagaagcaattaccagtgtccaaataagaaatgagagtaatagaaaactcagatttcattgtattataaatttaataaataagttacacaattgccgttcagtgcctgaaattgatttttctttttttgaggtcaaacttcaaccatgtatatgaaatgtaagagcaactttctaagcagaattaccctttctgatttccttgggttccttttggttctttaatctgtatgactaagagtgtggattggctgacattatgagatgcaattaatttacatgcttaagttaggactataccatcctgtttccatccattcttgatcacaagcatattacaaatgctgtgctggattatctttactattaagacatactgcagaaagccctgcaggtaaagaaaacaatctagggcttaccttagaggcaggaagaattgcatgttaagaaagctgcatacactctggctttttgctctttgagtttagctcaatgtcttcctaaactttggtgtgcaggaggtgactacgcagtatttaaaatctaatccatattatgtgtatagtatggatggtatagcaattttccaggtggatttttgacaatattttattttttactattcatgttgactttgaaaaataactacagggctagatttgattcaactgtccatggttagaatttttaaaaaagtttttgactctaatacaactgagttccatctacagaaagaatgcacatatggatacggctgtccagaagatcaaatatccttgtactgaagtatatctatatttagtcattattttataaaagtagtagaaaacaatagtggaatataatatgtggtctttggaagaatgagaaatcatccttacccattaaacacagacccaacacttaatgtatttccattttgatagtgacaagttttgggtttgggatgatgtgtcagccagggtcagttaacagacagaaaccacttgagtgactgtagcagaaaataatgtaacaagaggaattgggatctaggtattgaaaaattgacaaagagaagaggtagcaagtgcacaaagtagctaccgctcctagggctgggaagacaaaaggttagaattactaacacttagaacccttgaggaaggactctacaaagctgagctcaggtctgagtagggggctgctacgtggctggtgctaccctctctgggatagcaggaagggcccaatgggactgaggcccggacctctgccagccaggtggtgctggtatttctgcagcaggggcgatgaagctgattctctaagcttttgaaaaacaaaacacaagctaaattgaatagcttgttactaaaaagtgctgctgcaggcatgaagaagcacgtctagggaactgctaataaggacagtaagtgcatgggaagctagtgtgaatgagtaaatcctttgtccctcctccaggcttgcagtctccctctattgctccctacctttagattctgagagtcagtcagtaaagccagaagtacggtttgcagagtctttgcctcagcgttgcaaagtagggtttagaagggtgtgttggtatggctctgaggaagataaaatctctaaccagcatgagtgctaatatgtctaataagatatatggaaaataattattaagtatttgactgaatttcaaggattaaaaagcaatacttaaggcaacaaaaacatcttatatttccattaaagcataatttttcttacagctccttcacattggcaaaattagtttgccctcttgaatttttcaaagatgtgaattatggcaagtaataattgctgcctactattgaatatctggatgttgtagaactgccattgtatcatatttaacttatttttgagagtgttagatttcctctgatagaagatattttttacttttccaagattaatagtagaaatattgaacatcaaatcattttacagataatactgtcctaacattgcgtaagtatacaattattcatagactcagaaatcataattgtcttcacagaaagaaaccagttcagaatactttaagaactatttggaatgttagatttaaaatattctgtagccaaggtaaagcaagttagctaaaattccttttgtttctattgtttttagaactagcttcaaagagaaagaatttgataaatacttagtgtccaataggctctttcatacagttcaaagatgtagactgacactggcatctacagttcctagctgtacttactctggtattttttgccagctgccttcgtggtttctgcttcatacctgtttgtattcataaataactcaatctaagatttttagctttttaaaaagaattgcatacaatcatcatcagattacaggtttgaaagaaatcttagtttttttctttttcttttttttgagatggagttttgctgtcgttgcccaggctggagtgcgatggcgcaatatcggctcaccgcaacctccgccttctgggttcaagcgattctcctgcctcagcctcctgagtagctgggattacaggcatgcgtcaccacacctggctaattttgtatttgtagtagagatgaggtttctccatgttggtcaggctggtctcgaactcccgacctcaggtggtcttcccacctcggccgtctaaagtgctgggattacaggcgtgagccactgcgcctagcccagaaatcttagtctttttaactcagttttgagattctgccatatacctggcactgtagttaagagatggcatataaatgggaaaaataggtatttcaaaagcaatcaaaagcaattacaagactatatagtatgtcctaccacgggggtatgcatgggagcagaaggaagaagagacgaattttgcttggctagggttgtattggggttgaaattgatatcaactatagactagaaacttaaagggattttcatgccaacaagagtacaacaggccattcaagtccatctcttccaaacattgattaaacatcttttataggcagacaatcagttagttgctaagaagactaagctgaaaaaggcttttttttttttggccctgttggagctttcagcctattggctgattaaaaaaaaaaaaaaatgctgaggagtatgaagtcacaaaccaattgagttcaggaaccagtaagtagtttgacatgaccgtaatggaggttttgggatatgggcaattggcaaaaaattgaaaaggatgcgggaaaggtggactggggatacaatgtggatggatgattccttgctcaattgagatgaatgtgttcaaaaaaaccaggaagtttttttttatgttttgcatattagaaagttacatttggtggctatatgcagaatcgtgtatggggagagtacaggtgtggaggtcactcatgaggctaatgtctattcaaatgggagaagaggaaggtctgaaaggcaatcactattggaatacatgcaagtacatctagcattgttctgtctttctgaagatgtggaaatgaagctctctcagaattaaatgacaacatgccatggctgtttgttagagggaatggaagtagagattgaaggtcttgatttccagctgatcatcctttttatggtaccataccactcacccagcctgttgaactggaaaagattatgaacatcaggcattaacctaccaaagtaaagcaaaacaaaaacgctgaacttctccatatttttaaaaatatgtgacacatatatgtttattggaaattaaaatacagtaaaggctctttaactgtcattcaataaatattttttgaatgaacgacgatcacttgtcaataactggtattaaaaaagacaaatattaatggtgatctttattcaataatttcataaaatgggaacaaagtggtaatttgccagtaggatgaggagggcatagcagaggttgtctaaccttttggcaagggcaaagtcaaactggtgaataagcaacacaagctgtgatgagagtcatgtgccatatgtaaatggtgactctttcttcctccaatgctgtttatcaccacaggcttcccagcggcccaagaacagtctgccgcagtcactggcattaataaatgccatctctacctgaatgcccttcttttcaaatttttaccaaaaggaagatagtagactttcagttttccttctggctgtgagaggcatagggagaataacggtaacagatgcaggaataaaaaggcttgatacacatggatattatgtcatgagggattcaggagtttatattaatatacaaatattagttgttttttttttgtttgttttttgttttttgttttttttttgagacgtagtcttggtctgtcgcctaggctagagtgcagtggtgctgtctcaactcaatgcaacctccgcctcccgggttcaagcaactctcctgcctcagcctccccagtagctgggattacaggtacctgccactgtgcccggctaatttttgtgtttttaatagagatggggtttctccatctcggtcaggctggtctcgaactcctgacctcgtgatccacctgcctcagcctcccaaagtgttgggcttacaggcatgagccattgcacctggccccaatattacgatttatcctgccctacctcaccactcttttcatgattagagatggaaaaatttgatattatttaaaaatcagtaagattctatctaatcaaaccattggcagtataattcacaacttttttagagattttctaaagtaatacagatactgtagtattgtagttttgtagtatagctacaagaaaatcatactgtgctctgaaatgctatcttagtaacatattgtgttaatggattataatggtaatcaaaacctccatagagctacaggtttgaactctaacattctgtcgaagttaaagattaatcagtttaacaccatattatttttattatttttgagacgtagtctcactctgtcgcccaggctggggtgcagtggagcaatctcggctcactgcaagctccgcctcccaggttcatgccattctcctgccttagcctcccgagtagctgggactacaggcgcccgccactacacccggctaatttttgtctttttattagagagagatggggtttcaccgtgttagccaggatggtcttgatctcctgacctcgtgatccgccctcctcggcctcccaaagtgctgggattacaggcgtgagccaccgcgcccggcccattcctagtattttcaaatagaaatctgatgcctttattactgtaattagaggaatgcttatgtttcaggttgggttttggtaaagcccatgtggagaggagaatttgcatgaaagtagtttaattaaggaaatgttctcagggatggcaagtaggtgagcaagagaagtagaataggaatggggaagaaatcatgcaaggagcaatcgcaggcaaagtgccagcctcagtctggttctgcaggaaaacctgggcctaaactatgcttcagcttgttgcaacttgatacagaaggagctgggcttttgtattccagtagtcaccagtcattgccttaagactaccctaaggtgacataaacaccaaggcacttccggatctctgtttttgttggcaaagcagctttactagcctgaagacagtcatctaaagagatgtagatacagaagttttgagaagcaaagaccacaaaagccaaggaggtgggcacgcagaagtgttaatggaatcttagtggatctggataaaacacgattttttggctataacctctaaagggctaactttcagaagattacgtggacccaattaagcacttacctgaataattttgaaacatctctaattgtactatagctagagttaaaagaaaaaatattttctaatataaacaaaaagttcagaattatagcattattaaagaagcttttttcaaatgttagcattcctgcttcttgactttacatttttccggaacaaaatagttttccaaagagtatacttaatgacttgtgcagatgaattctaaatgataaccacagggctcttggacaagggatcatttaaattttgagttcttgtcagtcagacatatcaatccatatacatttccccaaccagggtgtcagaagtgtagtcaagtgagttttgtaatgatacttctttgtttacatctagctgcagaaacctcttaagactgattctgcatcagaataattgctagagggaaaagggaagctgtgattatgaaataacactgttatccactggcacccctttgtgtctatcttagttgaagctttgaggcacttctgtgtctattatttgattttaattggcaatggtattgattataaatcatttgacagaatataatttttatcttaaagtttaaatgtacctagaggctacaaagattcctgcgttcaatgaaaacattaaagtaatagtgtaagtagtttaaatgtgccccatttggcacagattagtgtcacctatggtacaactcagtcaaaaagtgaatgtagctgaaaactgaaactgttcaacagctccaaatttaagaaacacggaacattcactatgtgcaatagacaatgctagttttagtaggggattaaaaaaaaatatctttcagccaggggctcataaagtagtgaggaaacctacaacaacttcaagtcagataatgacaatatgtcattaagggacatgaacaaatgaccgagagaccgcaagatcaggagggactttttttggagttggttataaaggaatggcaaggcacatgggaatcaagaattcattcaaacagagccttgaagaaaggtgttggtggagtggaaggctagaacacaaaaatacaatctacagaataagaaagcactagggggcaactgtggttggagtacttacaagaacggtttaggaaaataactagttgtactacatagactaaattggataactgtcaagatttgaggattataggtgaagaaaccattttagagtttattataactgacattttgtatctagagacaacagggatatcagtattgatgtaattaaaggatgtggcaagaatgaggtgaaaataacttatgtcttagggctgaaaaattgagaggatggtggtatcattggatatggttagaaatagaaataagcaaaactatgatggggaagtgatttgtatttgggatatattgtctttgatgtattgatgggatatccaataatctccggaaaatatgtctggatctgaggagggaaatcagtgtgtgtttgataggtgtagcagtgagaaagtatcataggcaagataccacaactaaagaaaatggtttgggggtaatcaatatggagtttaagccatgggggcagatgatacggcaaaaggatattatacacagttaaaaaggaacccaaaaccaagtcttggagaattcacatttaaatacgtgcagatatagagaagccagcaaagaagtgttaggagaagtcacaggaaactgtaaagtgtctggtcacagaagcagcaagaaaaacagtttttaaggaggtgactacattgaccaaaggcagtgattgaattgaaatttacttggggtctgagaaaagaccattcggttttctggttgctttgactaattttaaagtaacaatttcagtggagtagtagaccataacctataaatgcattgatgtatttatttattcattcactcactaattcacttatccaatagtcattcatttattcttcggtgcttacaaccgggcctggcactggattaaagtgaaattagaagtagataaactggtagagatagccaaaacatatctccctacagaagggaaaagagcagaaaattatcatggaaacactttgcatagagtttctcacagcaggttgaaagtatcctaaggttatagcagtgtaggctggaggaaaaggagaaaatacagactaggcaggacaggcactggggaaattcaggtgtaactaagaagagactgagtgctgggagacagggtgtaatctgttaaatagaaacataggcaatagtaaatcagggaaccagaaagagttcaagagtcgatgaagagggacatgtatcaaggtctcgatcgagagggctgtgattcaaggcagagcctccattccagagggagcttaggatactcttctggttttctattactatgtaacaaaacaccccaagtacagtggcttaaaataacatctcttttatctttttatctgattttgtgaatcaggaattcagccgtgttcagcttattgatttttctactctgtgtggtgtcagttgacatcacttggcagaattcagctagtggatgtgctggtctggagggttcaagacagattcacttaatgcttaatgccattgtgagaatggctgaaaggctcagttcagcagggactgtcaaccagaggacttgtagatgtcttctacagcatggtggtttcagggtagtcagtttttatgcatggcatcttagggctcccagagtgagtattctaagaaacccataaagaggctaaaagttactaataatgatctaatcttggaagacctataacatcatattcgttgcattctacttggcagacaagttgctaagacaaatccgagctttaaggggagaattagatgctgcctcttgatgaaagaagtgtcaaataattttgtggccatttctagtccatcataactgctgtaaatttcctcctcctaccatggtattgagtgatgcatatctcacaggaggagagtgtgtcagtgactctagctgagaagggcagaagaaagaagatccttgcacaaacaagccaggcgagagagaaaactggcagtttttaggaaagaaaagagatgcatcttggcaggaaacaattgatggtagccagagttcaaggctcatgctgaccgttcattcttctacattttctaagctcaatctttgtatcaatagagaatatcagaaaacttccttggggaatcttactttggctctctgtaaaaatgaacttgtcgcaatgttctaccctcaacaatgggtgaacacagatttaagaaaaagacatgaaaagcttatctgttcttttgtgaaagtgccaaacactttctgttaaggttttcattgttgttaaagtgaaaatttggtatgacagctgctgtgagggatagacttaaggccttgcaactcaaattatggtctgcaatctaggagcaccagttgaggttttgttagaaatgtacattttcaggcgctatcctagacctcacacgagtctgcacttgactaacatcttcagaggtttcatgtgcaaacaaatgttgagaaactctgatctaagggatgtttcattattcagatcattgcaaaggacttgttaggttcctgttcttggtcttgtccctgtggacttcagattgaaaatcttacccttagcttaggctaagataaaattcctttccttttatttgatggcaattatacataacatgtcattacttgatttttattcgactttggagaagcaaagggttttggctaatttttagtaactattcttagcttttacaatgttatcattttatgtttgcattttttcctagccttatttagattctagacacagaataggggactgtgagtgctgagagtatccttagagaataaccactgtaacctacttcattttcatataagaaatgaatgctcagaaatgtgccttgatgtactcatggctacttaatcagtggtaaagctgagcctagaattatttcctcaaaattgtagtcctctgtacacttggatcagaattaacaggcaatgcatgtcataacgggctcatccaggtggttctaatatatactaaagtctgagaaacaggcctgagtgtagcttcaatgtctgctctctcactctaatgcctactgcctgccatatctagatgcctgtgtgtatgtgaacgaggagggaagagaattaaatcctagagatgttggtagccaattatctcaaaagcacatatttaggggtcagcttttaaaaggaggaggggggcttattcccctgacatttgagcaaagcaggaaagggtcggtgatgaaatgccatgtgtcctgaggacctacaggcctgggttatatgaccacttcaggaattgcatagcaatcaaaaagggaactaaaagaatcggaggctgggtaaaatcaggactaacaattgataaagcaattatgatcaacagtgagtgagagaaggagatttacctgatggtgaggtggtagccaccactaagattagtttaaataagattagccaccactaagagttttaaaatgaatgcatgaggcactggagtcttccattgcttctcttgccctccttgatgtcttctgacaggagccatagagatctttataaaacacaaactagatcatatctctcctacccaaagcctgtaaaagcatctctattacatttagtttaacatctctactgtggcttaccccttatccttctttgcccactaacttcatttagcatccacttcccctacttccctttgtgcatcttgtgcctgctatctgtaattcttccctttttataaaatctcctttttaagatcataccttgaattgtatctcttcagaaagggcttcctatagcttagccttaaaattctttttcagttgactttatttctaccttagcatgtaaaatgttgtcatctcttatttgttgttcatcttcttgagacagtaagctccagaaatgcagaaactaaatcattattcaatctaacctcatgtgatatctgtcacattgtagataatacttgaattttaaaaaggggacagaagtttcaagaacagtatactgtggtttaagtgagcaattcactgtgtgtgatccatggggtaggatggttcgaggtaggtgagaaagcatgaactggccatgaacatggacgcaaattgatcaaagtcattgcagcttagcaggtcaaaaagctgtgaggtcagagcatcagttaaaatgttcaatggtagttggtcatgatggcattagcaacctttaaatttaaagggacttaagtcacatccagaaatcggggatgacaagcctatagtcatcctctcttgaagtcttctgctgatacaagtaatcattcagtctgttggtctctatccccatgtcaccaccaacgatgactgggatccagtcaagcccttggatatcatgtcctctctcgtgtccttttcataccaatttaatcatgcctggagtgcccagaagcatactttcagtctcgcctgctttgacacctgactcattcatgccttaacctactgtgctagtgttatgatggggagggagggggtgactgagtggatttgacctcccaaaccatattctagcaagcaaggtacatcttaactctggaattcttctaaacctatatagggtttctgaaacttagtctcagagtgggagtggaatgatacagtactttgtcagaagctcataacaacgactgtgtcttaccataatccattacaatactgttcttgttccagttgaacagctggaagttgaaaaacatttcctttggaatgagtcaaactgtatcttacacaatcttcccagctcttatttacgagatagataatgtcattggtgctcaatatactaaggatttttcaatgcagggctctaatcttatcaatagattccagggaattactgagaaacacattatttgatccttgatgtctctttccttgtatttttatagtagcacgcttgaggaagtacacatatatagcttccaagaatgagggaaggcatcagttaatatgttaaaatagaaacctcccacttgatcttaagtatggggagggcgggggaaggagacaagccttaagcctgtttaccattgcaggtaaacaaacatgaagatcaaattctaagtaaggagagtttgttatggaatagctgagactgagggcataaagacaaccattcaaattattctagggtttcagaagacactgaagaaagaatagggagatgaactgttggtgaagcagagaggaaaaatagaccaagattaagagaaaaaaaacacgggaaaagattgcaggttggaggagggtgggtctatccaaggctgaggtcgaagcttacggcaaggatgcaggggaagaatgttttgttaatggtaaatagattgcaaaaattctgtagtttgcctgttcattctgatgatgggttttgtggttttttttttttttttttttttttttttttgctgtacagaagccttttagttctatctcagttgttaatttttagttttgttgcaattgactgatgtttttgtcaggaaatcaaaatctttgcctgtgcatatatcctgaatggtattgcttagattttcttacagggtttttatagttagtgggttttgtgtttaagtctttaatccatcttgagttaatttttgtataaggtgtaaggaaggtgtccagtttcagttttctgaatatggctagccagtcttcccagcaccatttattaaatagggaatcctttccccattgcttgtttttgtcaggtttgtcaaacatcagttggttgggtattagatgtgtgatcttatttccaagatgttggttctgttccattggtctatgtgtctgtttttctaccagtaccatgatgttttgggtagtatagtctgaagtcaggtagcattaggcttctagctttgttatttttgcttaggattgtcttggctatatgggctcctttttggttctgtatgaattttaaaacagttttctttttttctaattctgtgaataatgtcaatggtagataaatgggaatagcattgaatctataaattatacagtatggccattttcacagtattgattctatccatgagcatggaatgttcttccatttgtttgtgtcctcttagttccttgagcagtggtttgtagctctccttgaagaggtggtgcacttagcctgttagctgtattcctacttactttattctctttgtagccattgtaaatgggagttcatacatgatttggctctctgtctattgttgtaggaatgcttgtgatttttacacattgatttttgtatcctgagactttgctgaatttgcttgccagcttaaggagattttggggtgagacgatggagttttctagatacacagaagagacagtttgacttcctctcttcctatttatccttgatttctttctcttgcctgattgccctggccagaaattccaatacagtgttgaataggaatggtaagagagggcatccttgtcttgtgctggttttcaagggtttgtcataccaaaacctacagccagtttttgcccatctagtatgatattggctgtaggtttgtcataaatagctcttatttagagacatgttccatcaatacctaatctactgaaggtttttaacatgaaaggatgttgaattttatcaagacttttctgcgtctattcattcctttgcattcttttttctctaatcttgtctgctggtgttatttcagcaagataatcttcaagctctgaaattcattcttctgcttggtctatttggttattgatacttgcggtagcattgtgaagttcttgtgttttttcagctcccttgggtcatttatgttactctctagactgataattcttgttaacagctcctgtaatgttttatcatggctcttaacttctttgcattgggttagaccatgctcctttagctcagtaaagttcgttattactcatcttctgaagcctacttctgtcaattcagccgtctcagcctctgtccacttctgtgcccttgctggagaggagttgcaatcacttgcaggagaagaggcactctggctttttgagttttcagtgtttttgttttttgattctcatcttcatgagtttgtctagtttcaatcttggaggctgctgacctttggatggggttttaattgggattttttttgttgatgctgttgttgttgctttctgtttgcttttttaacaggtccctcttctatagggctgctgcagtttgttgggggttcgctccagaccccattcacctgggtcccttctgcacttggaaatgtcacctaaggaggctgcagaacagcaaagatggctgcctgctccttcctctagtatctctgtccctgagggtcactgaccagatgccagcaggaaccttcctgtataaggtgtctagcgactgctgttgggggtgggtctcacccagtcagggtgcacgggatccaggacccacttaaggaagcactctggctgccccttggtcgagggggtttgctgtcctgggggaatcccacttgtctgggcttcccggattctttagagccagcagggtaaagactaagtccgctgatctgcggagaccatggccacccctccccctaggggctcaggtccaggggaatcggagttctttccctaaacccctggctggagttactggaattcctgcaagcaggccctgcccagtgaggagggatgggtcagagtccggcctaatgaggcaatctggccattatttgccatagctggtgtgctgtactgcagggaattcctcctgggttcaaactgtccagtctccctcaaacctgaaggggaaaaatggtggactggagctgcagtgatggctgctgccctccctacaggagctcagtcctctcagtaagccggtagccaccgtgatggctgctgcccctccccacagcagctcagttctcttaggtggcagttctcttagatgccgcccctccccgggagagctcagtcatttgctgtaacaggcagctgcagtgatgatggccgcccccgcccccggaaactgagcagtcttaaggagtcgtctccatccgagtggcctgcgagaatctgcacagctgtgttttgagacccaaggccctgttggcatgggctcgcaagtgggatctcctgatctgcgggttgcacagatctgtggaaaaagaaagatttcccaggcagggtaggacaatcactcactacctcccttggctgggagtgggagcttcccttgtcgcgtttggctcccaggtgggccatggcaccaccctgcttttccttgcgctctcatgccaactgcctagtcagtcccagtgagagaacctggacacctctgttgctggtgcaggattcactcacggttttggttcttctcagtgggagcctctgactgcagctgttcctagttggtcatcttggcctctctccatatttttccatttttgatgtaactttaagtttttgcttaaattcccatattggatattacagtctaaaatcaagagaaggttaatgtggaccgagccattatttaaatttaaggttcaaagaggtaggtcattcagccaggtgagtgagcaccaatcttttaaaaagttggttaactatttgatagtttccacttttcaagctgataatgatattttaaaccaaggtcatttcaatttccttttggttcaatatttttggaaagttgctacctctttgaaataaaaatattttgtacaggattgtttacaattagcaaatgtttgctgataaagatgaatcactgaattaggtaccttttgtagttatgtaataaagctcttggtaaaaacttctatttaagcagttataactaatttttcctattgaaatgtcaggtacctattaagattttctcatagggcaattttaaattttttctttgagctttgtaagaaaaaaattgtcaactctactttcctttggctcttattcaactttattttaaaatgcatttttctagaaacactaactaaaggtgacagttttagttcacagggaactatttttgatttactatttttgttttggaaatgtctgaataaaccactggaaattatagcttataatgaagaaaacaagataaacacactttttatctaaagtgacagtaaaaatctagcaaatgggagaaaaataaagtcaacttttttttttttttaacttctccaattgaacgtcaaatgaacatattgggcaaggaatacaaccttagttgcatttacaatacagtggctacaacagaagagttaaacactaagtcttacgaaaggtagctttagaaatatttgaaagttggccgggtacggtggttcaggcctataatcccagcactttgggaggccgaggtgggcggatcacgaggtcaggagtttgagactggcctggccaatgtggtgaaaccctgtttctactaaaaaaatacaaaaatcagctgggcgtggtggcatgcgcctgtaatcccagctacttggaaggctgaggcaggagaatcgcttgacactgggagacggaggttgcagtgagctgagaccacaccactgcgctgcaggctgggcgaaagagtgaaactctgtccccccccccccacccccccacccccccccaaaaaaaagtgtgtgtatgtatatattaaggttgacactgtatttaaaaaatttctatgaaactgacaaaactattgcttcgttaattcttttttgcaagattgcattggaggaactgcatggaatataatgactgtgttcttttctaatagcacatgagtcagatctctagaaactgacttttgcccatattcaatttcagcagtaaaataatttctagcttgatatttctcataaaaactcctagggctcttttaaaaatattttataaatatctttataatgtggcttaatttttcagacatcttctgtgtagaaacaaatattcatatgtatgtacacatattagctattgctgtgtaataagccaccttgaaactcagtaggttaaaacaaccaacatactatttcaaatacatatgttagccaggaagttcttcaccttactgctaggattactcgtgtgtctctagttagctgggggttggctaaggggctttgctgatctcagctcagctctgcgaaatgtctggctgtctgctagtctgggaaaacttcatctgggacaactagggcaacttgactcggttccacttgtctcatcctcctgctgtctagctctgatgtgctcttacggtaaatgcagaggcatgaacaagagagcaaaagtgttcaagcccttttgaggtctacatttgggagaggaaatgccagcacttcaattgcactctgttggtcaaaatgagtcaaatgccaacccagatttaagaagcagggaaatagataccaacttttcatgagaagaacagcaatgctacattgcaaagggtatggattcaggaaaggatgaaatactaggcccaattttgtagttaacttaccatttacagcagttgctcctggacagtatggcttccttgccaaatatttttgcatgcaaataattggtaaacagtgccaatattggtttttcctaaacaatactatgttaaagtgtcagtcaaaatatgaattaaaaaatgcaaaacatggtaagagcttctcaaaattagttatgtttgaaagggtgaaaagaaaagacaagcagacatttgcctaagcagctttgggtggttaatcaagtcggtacactcggatggggtgtcttgtacctctctagtctcatgttccatccgtccacttacgttccaagaagtggcttatagttccttgaacagtgcgtctatttcatctgatccttagcatgtgaagtttcctctgcttgactttatcttccctttacacttctacctgttgataacctgttcaaccttgtatattctattcagggattttcactctgttgttctctccagtgaagatatcttttatttgtgccagcaccatacttacgacaaaaaaatcactattaataggattataacaccatgctataattatattcgcttaaatgtatatttccttcctaggctattacaaaagctgtgaaaacagtggcagtatgtttttatcttttatcttcccatttttcttaggacagtatgatgcataatactggttacatttagttgaatgactatccccctcgtctgacacataaggaaaataagccaagtgctatgtaatttatcagtgttcacacaactggcaaaatttaaattatagaactgtaataaataaaggcctatttgcttccagatactatattatttaacttacaactacaccgaatctcacatggaagactttcaagtaaggaactggcacttttcagtggatcttaagaaatggctacactaaatgccctagttaaactttttcttctgtttactactacctcatttaatccttatcaacttcaaggattatatttcttatattttgatttatatagccttaagtttttgttgaatgatatttcttctttagttaatataaaaagccacatttttcaaatacattagagtgaattatacattcgaacaatttgcagtgtgctctaaaatagtatttagtaattgagtctgctgagcacactggagtcctgaggagttaatgaaacccccgatgtcaaatgatataacaataggaatttgggactttgaagaattttcctaatgtatatatgtagaattatcactgttactatctttccattacaaatgggacctacaattaggagcaattttattggcaggctatataactgtatctgaccttttggaaatgatagaagaaagaaaagatatattaaactatctttgtagaaaagatgacgtaaaggctcaagtaaaactcacctaacccttgcccctgaatgtgatgatagtcaagcccagcttaaacagcagttgcaaagtaaagaatggtgtagagatctgtagatacactgcctaagtccaaattagtatctagcacttacttgctgtgtgaccttattcaagttacttatattgtgtctgtttcatcagttgtaaaatgggggtgactgtgaacattaaaacaacccacaaaaagtacacagaagtagcgctgacataaaccagtcgatgtgtgtaactcgcatctttctgatacatgaggtagagtcatataaaaattgtaatatttgacaatatttgacttcagaattggaaattgcataaagttggaccactaaaaggaaataaagcatagcagtgacagacgttctcctttaaatattttatcctctgtgacttttgacagaagatcttctttaaatattgtatcctatgtgacatttatcttttctgtgtttccaatttctttgatttggaacttcctgtagacagacccttacaggcatggaagaagaaagaatgaataaaccaaggatgacttcccagtaggtggaggatgggaataattaggaagaagctgtgtcttgtcacctatattgtccatacacaactgcaccgtagggtaattgagaaattataagaatggtaataaatacgttttacattcattaattaaagtcatctttggatgccctttgtccataatgtttcctctactagatctgaagcctaaatatcacttttcttctctgcaatttccctggaactgagtactcatagatgtttgtctagtgagccattccattatgtcatggtatatgtgtgtatttgtgtgtgtgtgtgtgtgtgtgtgtgtgtgtgtgtgtataaacacaatcttttttttttttttttgagacggagtctcactctgccacccaggctggagtgcagtggtgcaatcttggctcactgcaacctctgcctcccagattctctcccaccttagcctcccaagtagctgggacttcaggcgcgtgccaccatgcccagctaacttttgtatttttagtaaaggtggagtttcgccacgttggccaggctggtctcaaactcctggcttcaagtgatctgcccttctcggcctcccaaagtactggggttacaggcatgagccactgcgcctagcctatagatttcttttttgaagaatcagtgttatttgcatgctttgaaacaaagtgcttcatcttgccaaccttgtaccataccgtttctgtcagaaaagcaaccattgggatagattgtaattagccttcatttccatcactggctatctcaaatgcaaatcatgtatctatgtgaatcaaaagaaaaactggatttaggcctggtgcagtggctcatgcctgtaaatctcagcactttgggaggctgaggcaggtggatcacgaggtcaggaggtcgagaccagcctggctaacaaggtgaaaccccgtctctactaaaaatataaaaaaattagccaagcgtagtggctcgcgcctgtaatcccagctactagggacgcggaggcaggagaatcgcttgaacctgggaggcggaggttgcagtgagccaagatcacgccactacactccagccaaggtgacagagtctcaacaacaacaaaaaactgggtttaactttcagaatgttcaattttataggggatatttaaaggtggtgtaattagtataatcatggattgtaatcattccacaaattttaaaataactttgtgaattacattaatacataaaaatataagataaagcatttaccataattttattaatatttcctttagaatacctggtaaaatgaatgagtactgacctaacttaaagataaaacaattgagacctagctttagaagttagttttattacaaaacatgttaaggatagacctgatcagacaatgaatcatgctgactttttgttaagcatacttctgggttcataacatcccacttacatataacaacttgatttccattaacgatggtgtggtttcctatttaaagttcgaatgcacatctgtttgaatcatttctagtgtacttaatagagtaacatacatattgggttctagttaagatgctttataaaatgccaaataacattttatatctggagagattataaaaacttgtattttgtagctttgctcttgaacacttgctagctgcaaggaataacttggctttttcttgatgatcttcatagccagattttcgtgctttttttggtagagagaagtctctacaagtatttgacgctaaggaataatgaataaatacctactgattttatctgctaaggtccacaaaacattccagtattttgatatcactattaaagaagacgacggtgttccagtgatacatatgattccttacaatgacatcaccagagatagaaatatgaggcatgggaagtaacacgtaggccttcatttattttctgatatggacatccctggcattgatctccttggctcaaaggaaatttgcttccatgtctagggtggtgaatgtctttggcttatttctttggccctactctccacttttgtcttccttgggaggctgatgtctgtggactacatcaacaggctcctttgccctctggctactagttggatttggccaatgagagccttggtaagagagggagagaggaaagaaattccatcacccaatatcaaagctcctgtcagataatcttctcttctcagttctctctctatgtagtaactagaaaccactctccttcttttcattcttaggagtctaagagtagtagtgacacttctctattactagttccagtggtttcattataccttccctcatttttataaacagtcccttattaaactcttctcagattaccaaagtcctgctatggccatataaatttcaaaggagagtgtcattctccacctccaggtgataacatttaacaggagggaatgtaatttatttaatgtttttattgagcattttctatgctaggtaccataccagacatcttacatttattaacccttttaattctcatattttgaagttggtcccttctgttactttgaggccaacattacaaggaaagttatagacgatatggattatttggcttagaaagtttggaataaacgtgtgatagctaacacttacagaatatatcttacaaagtgccatactaagttcacttaaatctttgcaatatcaccacaacataggtaatgatacatgctctttctatagatgaaaagagtaaggcacggagaagttacttgcccaagatcacactgcagagctgggagttgaacccaaggcattctgggtgtacagtcaacattcttattcatggcatcataccattcccccgtgttttccaaagcatattttatcagtgtgacttttttctaaattccctctgcataaatctaatgtatttcagtcactagtattctaactcaaaatacaaaaccagcatttttctatctttaggtgactcctttcaagagaaaactaacctatgatgccacaagtcgtcatagtggccattcttgaggggagcttccacatagggggtgtgaggaagctgctagggtgttgatcatattctgtttcttaaatctcgatgctggtaatataaatatgttcggtttgtgacaattcattgagctgtacacttaagacgtgtactttcctctatgtatattattccgcaacagaatactgctttattatacaataccttttccaactcatatttaagaaaacaaaaaaaaaatcaactcggaaagcttcctatttacatgaaaatgggttgccttatttttctgggagctggtcagcagcgttcttcagtaagttttgaatccccagttttgcaattctttgtggtatttgcgatatttttggtgtttccaatgtctagggatttgtaattgcagaagtatcttgactttcttagcgacagttatgtccatggcttgtcctttttgtaatcagaaggtcatgctaaattatccctgtgttctttactttctactgaaacgtattgatccctttggattttcaggttaaaagaccaatacaactctgaagaatcagaaaccacttaaacaccttcacaaatgcatttcctttctcaaatttttttactttgatttgttccactttgatttggttcactttatttatgccacttgtcaacctacctatctgtgtttctttttgaacactgtttgtgcttccgtatttctttatttcatactaaaaaggatttggaaggaatactgtctcgtttttaggtcctttcgtgttgtggtttgggttaacaaagacaatatatatgcagatacattaaactgagtaatatcagatatccactcagttcacttgataagggaaatcttagtcataaaatgaactgaagacagagagctacagggtcgcctggcccaaggaggaattcatgttttgtgtgcttcacaaaatagttctcatacacttgaaaaggaagccattaaaggttgaattttaaagaaaaaatattgttcttaggatataaaatgccacctgcaacaaagacatggtgtatgttgaagatgaaaggggagaacaacaaaagaatacttaaaaatagtcaaaagaacaagaaaagggaggaaaaagcaagtttctaagtgcatcctctgtaccatctgcattcaccagttttagtaattgtatagggaataatgccttcccctattgacttgcactcccacagggatgccaaactaatagaaaacattttacatgtattctgcactttctaatataatatttttatattatcgaaaagactttaacttgtgtgtgtgtgtgtgtgtgtgtgtgtgtgtgtgtgtgtgtgtgtgtgtgagatcttgcttcgtcacaaaggccggagtgcagtggcacgatctcggctcactgcaacctccaccttcctagttctagcgattctcctgcctcagcctctcgagtagttgggatcacaggtgtgtgccaccacgcccagctaattcttgtatttttagtagagacatggtttgaccatgttggccaggctggtctcgaactcctgaccttaagtgagccacctgcctcagcgtcccaaagtgctaggattacaggtgtgagccactgcacctggccgagttaaacgtttttacacctagaatttggtcaaagaaagagatgcagacaaatagtgttaaaatgaaacataaaaatcaatctatatttattgagtgcatacgatttgccaaatctgtataacgttcctatgtgttgcagttgaacctcacgggagtgctctggagtaataatttgagccccattctaatagtgaataaattgtgcctcagaaaggctgtcacttgcccaagataacacagctagtgagtgagtgagagacctgagttcagaagttagctatttctgcttctgaaacttgggttacttttgctatagtatctataattctatagagtaagttgcaggcaggaaaattagaaccatccaagagaaatagtatgttagattttacctggggtattcatactacagggagaataaaactgagcaccgaaaggtctataaagttacaggctaaatgtagcacatttcactaaaaaaaaaaccacatcagaccgtgggaacgggggtgggggagatttttactcaaaagtacttaaaattacttttacataagtccaggtgtgatggctcatgcctgtaatcccagtactttgggaagctgagggaggcggatcacaaggtcaagagatggagacaagcctgaccaacatagtgaaaccccgtctctactaaaaatacaaaactgagctggacgtgatgacacatgcctgtagtcccagctacttgggaggctgaggcaggagaatcacttgaacctgggaggcggaggttgcagtgagccaagattgcgccactgcactccagcctggcaacagagcgagactctgtctcaaaaaataaatgataaataaatagttttacgttgaaacaagcatatattaaaagaagaaggcaaaatctctaggaatttttagcataaagtatatgctttcaaagaaatttaaaacctgcaggcactgtgtaatttatactgccagactccagggtaaattccttcaatttcatttcctggaaggatgctctggtagaatattctgagaagcactctattagagaatatggtgaatatgactaatagaaattggatttcaattgtgatactttaatatatcattgactctgtgagtttcgaaaataatacgatagcaggaactgtttctctatcacctcactgctttctctctctcggtgccccagctaggtgtacatggaatcccctacctgacctataatcctttactccctctccattttggttacctccagttttaaaagaagacttataaaagaccttggtctatgtatttaagtttggcccacaaagcaagattctgtctgcgtttttgacctttgcctagactttgtctccaaacccaaacgtagtccttgtgtcttggatgctatatgatcctgatggctttgggattcatgttttattctgtactccaagacttctctcacctttcccagtctctgctcctctttttgaataaacagcagtttatcacgcacatacttcttggtctgacagacttcaactttctaccctggattttttcttttcataaaaacaagtatctctgtcagttaacagttaactatattttcttcaacaatggacacattgcagtgcataagattattttttgatgagtttaaaagtcatgctttgctcagataagtgtgaaattttgctcctggccaaaggagggaaaaaaacacatcattttaatggcattgtataccttcattcaatttgaaaaacaaattattacactcaaaataccaaattattccaggttagatatgaagttcttggcagcactattagaaagtgtaaatttattttcttattactagagagctttccttaaagtttcattaaaatggcactgttttaagatttatgtgtatattatgtatagtaaagttgctttgttttagattaaatttatggatacatagtatatttagggggtaaatagatatattgatacaggcatgcgaagcataatcatatcagggtaagtgaagtatctgtcacctcaagaatgtatcctttctttgtgccacaaacattccacttcaaatttttttttttttttgagacgcagtcttgctctgtcacccagggtggagtgcagtgatgctatctgggctcattgcaagctccgcctcccgggttcacgccgttctcctgcctcagcctcccaagtagctgggactgcaggtgcccgccaccaagcccacctaattttttgtatttttagtagagacggggtttcactgtgttagccaggatggtctcgatctcctgacctcatgatccgcctgcctcggcctcccaaagtgttgggattacaggcgtgagccaccgtgcctggcccaaattcttaaatgtacagtaaattgttgactgtaatcaccctcttgtgttgccaaatagatcttactcattctaactagatttttgtacccactaaacattcccactcctcctgtccccaactacccatactacactctggtaaacatcattctactctctgtctccatgagttcaattgctttaatttttagttactgcatatgagtgagcccatgcaaagtttgtttttgtgcctggcttatttcacttaatacaatgtattccagttccatccacgttgttgcaaatgacagcgtctcatttttttttatgactgagtagtactccactacgtatatatgtaccacattttctttatccattcatttgttaatggatacttggattgcttccaaatcttggctattgtgaatagggttgcaataaacatgagggtgcagatatttctttgacaaactgatttcctttcttttgggtatatacccggcagtaggattgctggattatatggtagttctgttttcagtttttttgaagaacctcaaacagttcttcacagtggttctactactttacatccccaacaacgatgtaccaaggttcccttttccacacagccgcatcagcattgatgttgcctgtctgttggatataagccattttaactggggtgagatgatacctcattgtagttttgatttacatttctctgatcaatgatagtgacaaccttttcatattcctctttgacatttgtgtcatctcttgagaaatctctattcaaatttttgcccttctttcaatcagatgattatatatatttttttctatggagttgtttgagccccttatagattttggttattccttgtcaggtgggtagttggccagtattctctcctactctgtgtgttgtgtcttcactttgttgattgtattccttgctgtgtagaagctttttaacttgatgtctcatttgtgcatgtttgctttgattgcttgtgcttggtagggtattgctcaagaaatatttgcctagaccagtgtcttggagattttatcccaatgatttcttgtagtagtttcatagtttgaggccttagatttaagtctttgttccacttagattgatacttttgtatatggcgagagataagggtctaatttcattcttttgcatatccatatccagttttctcagcaccatttattgaaaagatggtcttttcttcagtgtatgttcttggcacctttgttaaaaatgagtttactttaggtctgtggagttgtgtctgggctctattctgttccattggtctatgtgtctgtttttatgccattagcatgcatttttggttagtatagctctgtagtataatttgaagtcaggtaatgggattcctagttttgtaaacaaggatcatttgattcttccttttcaatctggatgccctttgtttctttctttgatctagctaggacttgtagtaatatgttaaacaacagtagtgaaagtgggcatccttgttacagatcttagagaaaagtcttgtagtttttccccattcagtatgaaattagctgtgggtttctcatatgtggcttttactgtgttaaggtatgctgcttctatacccagttttgagagtttttatcatgaaggcatgttgaatttttatcaaatgctttttcagcatctattgaaatgatatggtttttgtccttcattctgttcatacgatctatcacattgattttttgcatatggtgacccatcttggcatccctaggacaaataccacttggttataacgaatgacctttttaatgttgtgttgaatttggtttgctagtattttgttgaggatttttgtatcagtatttgtcagagataatagcctgcagttttgttttctggatatctgtctggttttcgtgtcaggctaatattggcctcacagaatgagttcagaagtacttcctcctcctctttttcacaatagtttgagtattaggtgtttcaatgtttggtaacattcagcagtgaagccatcaggtctcgggcttttcttcactgggagactttttacatctttgatctcattacttgttgttggtctgttcgggttttgcatgtcttcatgacacaatctaattttgagtttggtttgctattctagttctttaagatgtattgtttctcttttttttttttttttgatacaagtgcttattgctgtaaactttgctagtactgatttatctgtagcccacaagttttagtatgctgtgtttacagttttgtttcaagaaattttataacttccttatgaatttcttcattgacccactgatcattcaagagaatatagattaattcccttgtgttttgtataattttcaaaattcctcattactgatttctcagttcattcaactgtggtcagataagatactttatatttcaattttttgaatttaaggcttgttttgtggcctaacatatggcccatccttgagaatcctccatgtggtgatgagaggaatgtacactctgcagctgttggttgaaatgttctgtaaatatttattaggtacatttagtctgtagtacagattaagttcaatgtttcctagttgactttttgcctgatgacgtccaaggctgaaagtggggtattgaggtttccagctctctttaggtctaataatgttgctttatatatctgggtgctccggtgttcggtacgtatatatttacaattggtatatcttattgctgaaatgattcctttattatatgttgatctttgtctcttcttacagtttgtcttgaaatatattttgtttgatgtaagaatagctactcctgttcttttttggttgctatcgacatggaatatctttttacatcccttaattttaagtctggctttgtaggtgaagcgtgtttcttgtaggcaacagattgagtcttggtgtttgttgttgttgttgttgtttgtttttttttttttttttctgtcactgtgttttgattggagagtttatttcatttatgttcagttttattattaagaacttattcctaccattttgttttctggttgttttgtggctttctcttccatcctgtcttcctttttagtgaaggcgatttttctctagtggcatgcttttatttcttgctttttaaattttgtgaatcttagtatatcttcttatttgaggctaccatgaggtttacaaacactataacccattatttcaaacagacaacactggttgcataaacaagaaagcaaagagaaaactaattaaaaactcaaacttcgtctcttttaatctttttgttgtttgtttatatctcattatactgtctatgtcttaaagttattagagttatttgttaactgaaagcttcctttttttactcttcttattcaagatatgagtagttcatacatcacaattacagtattacaatagtttgtgtttgtctgtacttactgagttttgtgccttcagatggtttttctggctagttaaggtcctcttctttccagttgataaattctctttagcatttcttgtagaacaggtctggtgttgatgaaatcccacagcttctgtcttggaaggtctttatctttcttgttggaaggagattttcactggatgcactatcctagcataaagggtcttttccttcagcactttaaatatggcatgacatgtcttagcctgtaagttttctgctgagaagcctgttactagttgttgttaagctttttggaatgtatcttttctcttgctgcttttaggatcctgtctttatccttgacttttgatgcttgccatctaggagccaaggcctgaagttgcatctttatgaatctatctggtgctctcttctattgtggcagagctggcacccaagccacaatacaaagtttgtcccattcttcctttcccatttcataagcagaggaatttttccccatggctaccactgcctcaggctcatggtgagtactgcctggctaccactgatgttcactcaaggcccaagagctttttagttaactaggagtaaacgctgcgaggcctgggtctctccgttctgtgcagtgggttctcctcaggccccaggtgagtccagaaatgccatccaggagccaaggcctgcaatcagagaacccaggagcttgcttgatggtctacctgactgtggttgagctagtacccaagctgcaagacaaagtccactctattgcctctcctttccaaaagcacaaggagtatatccccatggccaccacacttgggaatgcattgggccacacccaaagacagcatggctctgagtcttacccaagacttggtgaatactgcctggctactactgctgcttattcaggacccagggactctttagtcagcaggtgacgaattctaccaggactggattcttctcttcaaggtagcaagttcccttctggccctgggtgtatttaagaatgtcactcaggagccagggcctggaatggggggtctcaggactctgcctgatgccttatcctactgtggttgagcttgtgtccaagttgcaagacaatgtcatctttactgtccctatcctctcctcaagtggaagaagcagtctctctcaaagctgtcagctgcactgttaggggttagaggatggggtggtacaagcactggtgtcttactgggttgtgtgcccaccaagtcccctgacttcgagtccagcacgacaccaagacttgcccaggaattgcagtttttgtagcctagactccctttgaagtttatttaggaccccaaagtgcttgagctcacactggtgagactagctggaactcagcttctaactgctgagatgggtgatacctccctggatagggctggtctaaatgtgccctctatgtgcgcttgatgaattctgccctgtgttgcttcccactgtgacagggcagcactgggttccaatgcaacgtttcacaatcctgcgccctccctcctgcaagcacacagatcgtctacatgagacatggcctctgccaggggatgggggaggggtggtgttggcaattcgtaactgtctttcctaccatcttcagtgcctctttccttgatatgatattaaaatcaagtactgtgattgctcacttgatttttggtttttatgtaggtgcttgcttgtgtggctatctgttcagtttggtgtttctatagcagcggtagcgggaaagatgattgctggaaggttccatgtatttgaccgtcttgttctgcctccctcctagtaaagctattctttaaaaattctagcatgttagggttttgtgttatgttctttttcccatggaatttgaaaatggatctatttgagtagaatttcaaaagaataactcataatttttgtctaagtatatatgtggctggattcacaaagctgggcacacagggactggttggttgccgcaggtatcattgttccctgcttgaagtacccgggcatttacaggtcttgtcattgacatggctacctggttgtaggaatagtctaaatcctatgtttttaatcgtggaagtttaagggatgtcttttgcctggaaaccagggattttcttgacttgtgtgaaattcaaagtttatatgtgatccaaggagtgtatgtaaagagcacagtcacccaaaggctaatgttagacccatcacctgacgttttttggaaagtatttgttgatcccaaggcttgtgagagctcccactgttacatgttctttagtcctttctaatgcttctatgtaatagtaccttttaggaatattttctttgctggactctaagttctatagggtctgggcctatgtctgatgtactagcatatgattcagtacctagctcaggtttattcatgctcaatatgtctttgactgattaaattagggatttccagataggtgatgaaaaagctgggaattacctcatgaggggattgtagggttttaagcagaaaacgatttggtgaagtatgacaaaagaaagacaaatgttagaaagataatcaaatagtaggttataaaaggacaaggaagcaacataagattgaaagaacaagaacccagaattagacagatctgagccataattttggctttaccccattctagtttcatgacaaagagccacatactcatcttacatgagatacttagaggttaagtatgttactgctaatctcagaaatgccacaacggttatgaaatccactcatttaatagtgtgtctcatgagtatttacgttaaaaatgttaaatattatttattgactattatttttccttagtataattcctgagcaaagaactgagtaaaatagatgaaaagctctcacagggttgtttcaaacctaattaaacccgatattcctaaaatttgagttatccagtatgagaataggtcatagcatgcaaaatgtgtatgcacagcaagcatgttttgagtgataaggatgtcgaaccactctgactggtatattccaagaatggttaaactttatgtacccacccaggtagattgtggtcttttgcttctttgtgtatttacttttccctttacccgtaactgccttgatcatgcctgtattttttctctccttcatagaatctatattcatttcagtgaattaattagatcatttagggtataaatctcttactcttgctattcaaactaattcaaatagacttgacctatgataaaatttttaaattttttttgtcatttgaactttccttttttcatccgtcatcttcggcagattaattatgcacactaattatccttaaatatagctttagttttcaaaaggggataatcgtgaaaatgtatcattggaagtgtgctttgttaaattgagtgtattttttttaatttcagtttgggaagcagcatattgagaacctcttcagtgacctacaggatgggaggcgcctcctagacctcctcgaaggcctgacagggcaaaaactggtatgtgacttatttttaagaaagttaactttaaacttagtagaatttcagaccagaaactgacaacatagttttatgacatctagtagaatgactaggtactgattgaaacagcaatacctattccttagtaaagcaacctcgtatgattttcatttggcatactctaccgcctgcagaaaaagtaaaaatttcagtaatacaatttatattaatagatattattcagttttactacttggtatctatcttatcaaatatcttaatgaaggcttttatacataatgacttgagaaattatctttgtacttttgtgtatttttgaagttattttacaaggaacctgtatgagtttatacatgtgggatagcaaaataaggtacaggcattatagtgtaatacgtgatagcatatgtgatgaaaatatcacttcctcttgaactattatcttgtctaacttcagagcattcctgtgaagatacatgattgatatacatgattacagatcagtgaagtcatgttgatcaaggtcttacactggggggggaaagaactcaaattgaaatcccctgactgaaataatcgtcttagattgctattctaaaaagtagagtttaagcccccagtctatagtcataaataactgttctacctatcaaattctgctaaatcatagccttcgtctcttatctttgcccttcattacaactccccagcacatgcacatacacacacagacacacacagattttgtcatattatacaaactgaagctgtcgttcaaagtcagttagcaaaaatcctatctaccccagcctgcctcctgtaacacttaacgctaagccactcttttctcggtatatattgtcagatatctctgggtttttgcctgtattattttacttgcctgtatttctttttgtacttctgtctaccccaactgtctgccagaaaccttgatttcacctcagtaaagcttttcccaaattacctttgctaatttttccctcccaaattccacagaaggcccatttttgtcttgtttttagtgtatgtatgactgacatccctcctcaattaaattctgaagtcctatacagaagagacatacctatgctttcattttttatcttcagctatgtgagattaatactaaaacggatccatttttttcaagaagtctgaacttgtactaatagaagaacaacttgatgacatattgaaataataactttagtcaagggggaaaatcagatttaataccttatagctgaactgtttgctgggcgccaatttgaggtcatcatgtaaacttggtcttaatttcactagttagagatagatttgtgtgtaattcatctcctatgactgtgaacaatttacatatatatggatacgtagcatatgtacagaaatcagtgtgtctgtgtatctcgtttctcctgtattctgaagtcagtcctactttgttaccgaatacagaagtcccagtgtcttccaaatgttcgtgaaaaatctttcaaagattatggcttactcatcttgtcctggccctctgttaggaggctgttgtctcttcacttccaggtatctgcgtgatcacttctcctgtgttgcaatcctctggtcatttccctgactgagtcaatccatctatcacccaaagcaatttagtcagggttaacaaatttcatacataatgtttaagataatgaatttcagatcctttcgtaattcataagcatgatttgggtgtttatactcagatatgagataagcctttctctaaacttatgatgttggcacactacccatttgatataaagaaaaaaccactaatttcggcaaaattaaaaaatccacatgatttgcatttatgcatatacatacatagacgctaagacaaaatgaacctaattagtaatagcattaaagaaaaaaatatcaaacaaaatatccatgagattggccagtataaggtaagctagtggtagggaaaaatcaccaaacatttacacatggcagtgtagattacataatttcagatactgctactaacagaatccattcaccattgtttgtcctaatcacagatctgtcagccctggtctgaggattttgcctttctcataaagcagaatcacctctaacaaatgctcccgatcccagaactccaattcgctatgccttgtcttgaattctaatagtttctgtagagatatatcttctactcctaatgggaggcatgtatactatagaacagaaattttagtattctactcagaagcatctgcatttggattattggctcaggacatccccagggttaaaaggaaggtacttgccttacaatcataaaataagaaatactccccaaggagactctaataggggcagattttaagttcccacttcaggatcagaaactgcagctttttaaaagagtagactatgtttggttctaatacatatgcacatgtgtacatttaatgtttgaatatgatacaaaggaaaattttgctaaatcttgtgactatataattacataattgaaaggaaatatgtggctttggtctaactactaggcagagaactgatttgagtaattattttcaaaactttaaagtcctataattaccattaaacttgtatactgtcaatctatatatacacaagaagattggttatttgctgtttttctttcatgtattttttttttattttgatggaatcttactctgtcgcccaggctggagtcagcgacatgatcttggctcactgcaacctctgcctcctgggttcaagcaattttcctgcctcggcctcccaagtagctgagactacaggcatgttccatcatgcctggctaagttttgtatttttagtagacatggggtttcaccatgttggccaggctggtcttgagctcctgatctcaatgagccacctgcctcagcctccccaaatgtctggctgttgcttttttttttttttttttttttttaaatctaaagtcttatttttttcctctttttggtggaaagtgggagaaatatcagaatgtaaaccaacatcattctgacattcttggaggaaaatctaagaggtaaaaatggagattctggttcataaggttagccttaatgttttgtgaaatcaaaggaacaagatgtcaatactgtgttataaaggatatcaggcaagttaccttggagagtaagatggctttagcttaatttgggttgttcagcaggcagtgcaaatgataaggagttctagggtgaggaactacttgagaaagaccaggagctttgctggaaagtataggagttaaatgcaagacacagaaatatagatatttgtttggtgcatgcacaaggtagttagagaagaaggaaataaatttgcaagactggggctctacagacacagacaaaagtttgggtcctggctccaccaattattagttatatggtaatctatatattagatattttaacctgaggttcacttctgtacaatagggatgaaactaactgccttgcaaggcggggattaaaggtagtgcattcaaagtacttggcacatactacgaagtcaataatatttatgttggaccaactatgtgacaagcaccaatcttagtgctttatgcatatcgacacactgaattctgccagaaaccatatgtacaatggtttgagcaatatgaacaataagtagtgccctggacaaggtctggatcctgtgagacagcatgcttcatgtttgagtgagggctttgacctcaaatgcagagaagaaagtatgtcgaattctcttgtaaatcagagcagttgttattgagagcacatgttgtaacttgtgtatgcctcttgctaatattttcattaagtccatttttaacagatgagaaaactggtatacagggagattaaattttttatgtaggccagacagcacaaaaacagcagagctgacaattgaacccaggcagtcagctttgtagctcttgcccttaactgttacctataatcacccaaatgtttaggtgagaactttgcaagtggtttgcattggcagtgggcttacttcaggaacgtcattgttgatggtatgaaggaaggatgaaaaaaatggtgagtgagtggagaagggaaagaggttagatttctctgggcaatagctaataagggcttgtagtaaggtaaaagaaatgaaaatgagagtaaataaaacaggttatcataatggtagaatttctaaaactctacaacttaataaatgagttaatttgtatattacaatgaactatgcagatgttggtttaaaaattacaggataagatacaacttttgggattgagaataaaattagggaaccaaagtgattgaggtttagagcttcagtgacaaggacaattaaggtaatcttcacagaaaaggtttcctttaaccctatttggcattatataattttgctagagtcaaatctcctttagatttttctaaaaagtttgggaattgtttttctatcttactagaaaatgtttttatgcatgctgatgtttctgtcattggtggtcatgcagtaatccccaactgggctatagaatgaagaaacaatcataccaaaataggctttgtaaagaaaaagtgttgccattcttagagtggttggtttatgctaaaaacgtaccaggccaaggacaattagcgcaaagtatttagattcattatattaatgcctcacaggctctgttcgtttacaatattcaagcttaatagtgaaattataaatggtttcatttctagtagattgtcggtctctctgctggtcagtgaacactcttttgttttgttctcagccaaaagaaaaaggatccacaagagttcatgccctgaacaatgtcaacaaggcactgcgggttttgcagaacaataatgtaagtagtaccctggacaaggtctggatgctgtgacacagcatgcttcatgtttgagtgagggctttggccccaaatgcagagaaagtatttcaaattctcttgtaaatcagaccagttcttactgagagcacatgttgtaattcgtgtatgcctgattgtggctaatataattcaggaagcaaatgcatgctgccacagagggaagggaaaagacatagacctgacctgataggctgctccctgttttcagattttacttcatgaagctgtgtttggtggacaaagtcctgcagtcaactcggtttcttttcttactttgcttttctttttcttttttcttttcttttcttttcttttctttttttttttttttgagatggagtctcgctcttctgtcccaggctggagtgcagtggcgtgatctcggctcactgcaaactctgccttccaggtttaagctattctcctgtctcagcctcccgagtagctgggattacaggcacatgccactatggccagctaatttttgtatttttagtagagacagggtttcaccatgttggccaaggctagtctcgaactcctgacctcaggtgatccacctgcctcagcctcccgaagtgctgagattacaggcgtgagccaccgtgcccggtgaactctgtttcttacggcagtgttttgtgcaacaaacggatttttctataccaaatatttatgtactaaatgtgttcaaacctgataatgatgtttgtttaaatcaagccaacacttattaaacgctgtctccaagcatataaattatacagaaacatcactatttttacttggggtatgaatggcagatttgtttttttggtttagatttaactggattaaaatacgtgtgttgcattagaagaagtaaacagtcacagctaaaccaagtaggcaggtcagaggaattctaatctcctctgaaccacttggtgactcttcccctgtgtcatggcattggaggcagccttcctttcttattaacatcctaaaatctgtctaatcgaccaatacatttcaccaggcacttagtagctccctaattacattacctctctctttcaaagataaactcaagtacattgagtacgttgatcacttactcttaaaataaccataagcagggatagattaataataacatgtactcccccaaatgttgctcagcttatctggcagggagatgacattacataagatatggaaatggaaactgtgcagcaattaattggctgattttatgaattcagggtcattgtcacctttaacctatgaaagttattttacagagatgtttgtcttaggaagaaattaactagatttttcactccgcagccagaataatctatgagctgattttcttgtttattagtccgatggactctttggaaatatcagtgtcattgacattatgagaattgttaacaatattaaagttacacaaagaaaatgtctttgaaatatcaaaatatcatattctgtttcaaaatgtagcagtgaagaaaagagcggaacacagaattattagatttaatttatttgtagcttgactgtccccagcaagaaaatgtcatttaaaaaaacaaactttgggatatcctgtaaaactcaatcctgcataaagaaaatgcggtacaggtcgggcgcggtgctcatgcctgtaatcccagcactgtgggaggccgaggctggcagatcaccagaggtcaggagttcgagaccagcctggccaccatggcgaaaccccgtctctactaaaaaatacaaaaattagctgagtatgctggtgcatgcctgtaatcccagctactcgggaggctgaggtaggagaattgcttgaacccagaggctgaggttgcagtgagtggagatcgtgccactgcactccagcctgggaggcagagcgagattccatatcaaaaaaaaaaataataataatttggtacatatacagcatgaaatacaatactatgcagccacagaaaagaattagatcatgtcctttgcagcaacatggatgagtctggaggtcattatcctaagtaaactaacacagaaacagaaaaccgaataacacatattctcaataagtacgagctaaacactgaatgcacacgaacacaagggaacaaagagccagcagcagctagtgctggggaactttgagactcctacgtgataaatcatgaaagggtgtatggggggggtcttacttgcaagtatgttttgggaggttttttgggcacacatgctctggttgtacatgctagcacacataccacatctcattggcatctaaaatctccacccaggggtgtgtgggtttttttgtttgtttgtttgtttacactattacaatgagcaaaagaatagggcaagtttttggaggagtgtgtgcatgcttgtcagtggggaaaatccctagcgtggttatctctggcgagggcctgagaagtcccctttggggctagaggagcccaaccacaaggctagacataatcagtgtggacagtgtgtgtattcattgtccgtttcgctgattgtcaacaggcagcactgactcagtgaaacagcatcttcaggacttcttttctcaatggggctcccttgcctgctcatttctggctatctgcctactccaagggaaccagaaaaatcctggcaataaaacatatagaaggaaatttatatgactttgggataggcaagtatttatgatacctgaatccaaagcatgtttcaaaaagagaaaagttaacttggacttcatcaaaattgagttattgctatattctggatatgagccctttgttttgagttgcaaatgtattttccttttctgtggattacctttttactcacttcaatggttaatattaataaaaacaagttctccacttggatatagtttattctttaaaactttatatttttatgacctgttgaagaaatactggcctacccaaagccattatgatactatattaggttattatctatagaaccattatcgttttaccattttgtttttggatctgttttacctgaaattgattattgcatatggtgtgaggaataggttaagactcagtatttattttatttgaagtctaattaacacaccatttattaaaaataatgcttcctcattgcttcacagtactaagtgtgtcattaaaaatttgtccgtacatatgtgggtctgtttttgcacttcaattctcttgcattgttctctctctctctacacacacaaatatcatgtaatgtggagtaatgtagttttataatacagcctagtatctggtgaactaggttctcccactttgttcgagattttattggttattggccctttctatttttgtatttgttttgtaatcttttccatttacatgtacattcattttaagtatgattaacattgagttaaatctatagagaataactgacacatttacatatggagtatcccagtcttctgtttttcttgattttttttttaaattttaggttttctagaatgagaaactgaaattgaacaggaacacaaaaggtgttcacaaattcaagaatcatatttaagaaatgtttaacctcagcagtaacttgaggaaatttaaattagagctgtaatgagataccagtacaaaattaccaaaatgactgaactagactactaatgccaaatgttgatgaggacatggatcaactggaaatctcacaattaacttctggaaatataattcaggcaactaattaaagagttgggcatgatctactaaatgtgaaaatgcacatttcttaccacccagcaattctattgtagacatacaagttacagaaatacatttcccagtttgccaaaaacacatatatatgtgagaatgttcatagcagtttcatttgtgatagcccaaactggaagtgactatgatacattctcatgatgggatattacagagcaatgaaaatgaccaaatgatagctacacacaatatacaagatgaagtcgttaaaatgtatttgagtgaaataaatcagacaaattatacctactatgatttctttcaattaaatttcaaaaacgggcaaaatgtttccatgggtttaaaattgaagagagtggttaacttttggaaggagtaagtcagtaaaacgcataagagaatcttctgcggtgctcactgttccatgttttgacctgatagctgttacacatgtgtatttactgtaagaaaacgcatcaagttgtacacttatgtatatttttctatatgcatattccacttcaattaaaagaggaacttatgaagggaacttaaaacctccgaaactccacgggccatatatagaaatctgatcatagaccccatgttttctaatgaaattattaaatgaatataagtgaatataaaattagaatatgatgtcatatgaatctcttcagggaaggccacatttcttacagaaaatatagaacctcctaatgttttagtagggaaaaggccccaaaataatggcttaaatttgagaaggagttgttcaaaagcagatattaacaatgctttcatctgagctagagctttaatggggagctgcataagatgctggcctatgcgttagaggacaaaacctcaagacattctcatgcagaaaccaaacttggaacaaaggaacctttaccttagcctgtggctgaacaataacacatggattttcaaaagtaaatctaggctgggcgcggtggctcatgcctgtaataccagcactttgggtggtccaggcgggtggatcatgatgtcaagaaattgagaccatcctggccaacatggtgaaaccccatctctactaaaaacacaaaaattagctgagcgtggtggtgtgcatctgtagtcccagctactcatgaggctgaggcaggagaatcacgtgaacctgggagcagaggttgcagtgagtggagatcgtgccactgcactccagcctggccacagagtgaaaaaaaaaaaatgcattatcttataattctccattttgtcataagtataaacaaaaatggaaaacatccataagtacaactttagtttgcttattaggaagaataaatcaaaatgctcaagcaggattttttttctaaagttgagcttgggtgtgttctatatcaataagcctgtgcaggatataaataatcacattgaagaagtcctatccaaatttccttttaaaattcacaggtatataagttgattgattggtgtcagagcaaacacaaccctttgtgtgtcagagattacagccacatggtaggcaatatgaagcatatatacttaggaacagttaagtgaataaaaaagagatacatagaataagaggtctgagaagaccttttggttcagttcctatatgagcagagacctggagaaagggagtgagccttggaattgtctataggaaggtgggttaggcacggtaataaagaccttaaggtgaaaaagcatttggaatgaggcctcagcaagtggagtagagtgagtttagagataaaggaaacatagcagagataggggagcagagaggtagtaaggtgggggtgagaagaagaaagcatggtgagccattgttggcatttggactcaggtctaaatgagatgacaatgactaaaaaaacactactagaaattaaatgggtcataagtcaggttattttaaaaatcagtaatagttccaagtctttgctattgtgaatagtgccacaatgaacagatgtgtgcatgtgtcttcatagtagaatgatttataatcctttggatatatacccagtaacaggattgctgggtcaaatggtatttctagttccagatccttgaggaatcaccacactgtcttccacaatggttgaactaatttacattcccaccaacagtgtaaaagcattcctatttctccatattctctccagcatcttttgctgactttttaatgattgccattctaactgttgttaaatggtatctcattgtggttttgatttgcatttttctaatgacaagtgataagcattttttcgtatgtatgttggccaaatgtccatcagtgatagactggattaagaaaatgtggtacatatacaccatggaatactatgcagccataaaaaaagaatgagttcatgtcctttgcagggacatggatgaagctggaaaccatcattctcagcaaactaacacaagaacagaaaaccaaacaccgcatgttctgactcataagtggtagctgaacaatgagaacatatggacattaggaggggaacgtcacacaccatggcctgtcagagggtggggggctaggggagggatagaattaggagaaatacctaatgtaggtgacgggtctatgggtacagcaaaccactatcgcaggtgtataactatgtaacaaacctgcacatgtaccccagaacttaaagaataataaaaaatataaaacaggaaaaatcagacaaaatgaaaaatcagtgatagaatactaacaaacttagagtgtcattttattcaagaaagttacagtcaataacgaaaacgtatcgcacagtagaaatgctgctaaatccatgaagaaaaattgatggaaatatatttttagagccattaattcaccactgtcaagtttatgacatatttaacagcaaaagattgagagtacaaataactgtaggtttaatagtgattttctgtatctcaacactaaagcatagtagatacttctataaaatatgagcattatcaataaatctccctatgaagttggatgtgcaagaagagcaatagtttaaaaatttcagttacattaactaaattcaagtctgaactctcaacaaggcattcagaaaatcgtatgtctgtcattattgggaatgctctcccctgagcctatggaatggccagagctcagtagatccacatggtgtctttcatagggcaaaagcattttcattttcagttcattgaggcaaccaagtgatacattcactatacaattttaaggtatcttgtgaagtcaagtgtattaactgtcctgatattaaacacgtggcatacagaaaaagttgaagagagtgtaatcaggggaatatttatagaaacgtggggaggattaaaggaagaaactatggtgaagaatgcagggattcacatgagttaataacctttactacatctaaacctaagcagtcaaggggagagggctattaatttgataaaatccctcatgttgggagagcgccactggacacaactgtgaactgagcccctaggtatctaaagaatgctgttagtttcaaatcattgcctggtgaagttgagagaagtgataccttagtctctccatagaatcctccagtgttttgccagtgccgctccttagtttagtctaaccagaagtccaaggttaagagattccaggtgatgtagtcatcacatacaaagaagaggtgaagaagtttggtgggttagtgaagtaggagtggaaaacggtataatcggcattccaggtatctagttctgttttgtttctgtgcgaaatgaggacttgagaatctgcatgccgagaactctgatgttggctagggcccagtcttgttggatgcatcaggaagccagtcacctttgaggccataccacttctatttgatgacagagagtagacgtggtttctggctaatttggggactaaggactccttcctattcttctggagacaaccagagccagaaaagaaagacacgctgagagtcacttcggatatctgctcttcgtcgtaaacttgttaaaggcttaggaaaatagtaaaaaaaatttcctgccacatacacaaattataaacgggcaatatatttgaatgcagtgaaaatgtcattaaatacacacaaactttcaaaattcatgttatttaataacagtagaaactaataatatacttataaattaagtttgattaaggtttgttaaaccaagagtataaaactacatttgtgaaggaaaaagcattccatatgaaaacccatgagaaatggctcaggctgtactgagagtttgaatttttgtctttgattttgatcttcattaaaaagataaattgaatcaagctttcaaataaaaatgttacaaaaatgctttaaggaaagcaggaactaaagataaagaaatagaagaaacactagataaaatatacagctagttccttataatatgaaatagattaatatcttatgaatgtgatccagacaaggagggagaaaaacaaatgtatgcagtttaaaaatggaagggaaatattaagtatgagatatagaaaccaaaaacgggttttacacagaaatacatatatgtttattataaaaaatgaagttgaggccgagcgtggtggctcacacctgtaatcccagcactttgggaggctggggcgggcagatcacctgaggtcaggagttcgagaccatcctggccaacatggcaaaaccccgtctctactaaaaaaaaaaaaattagacgggtgtggtggctggcgcctgtaattccagctactggggaggctgaggcatgagaatcacttgaacccatgaggcggaggttgcactgagaggtgatcataccactgcactctagtctgggggatcgagcaagacttgtctccaaaaaaaaaaatttttttttgaataccagtgataagtttgtccacacaccaagaaattgataattgctaatagaaaatcatatgaacagcctcctaattctataaacctatgaaaagaaaccctggtttaaaaaaatcactcaaaatttagccctctgatttttaaaggaatattagaagtgtcttttcaaaatgatactttttggtaatttctggatcattaagtcaaggtcattttgtcttctctcttttccttagggtctcctccattttagcctgtccctctgccataaatcactagttctagcatattctgtagttctaaactagctcctcagtttaaccctgttcctcagtttctttcctttccctgtcctggcgtttaacctgttatcctcacttgaatgccactcagcttatatctgtagagctcagacactacgtctgtgttccaatttgcattctttgtggtggctgttttagcatgaagttatccctgctgtcaataatgtattttggaaagccacttattgagaagaaagtacttctaagtgcagtgataactttattgcggtatttgctgagagcaaagctcatttgtaatagttggttgtgattttaaaaagcgaacaaaatacaaaatcctgagaaatgggagactatgctactaagtggttattcttgtctctacatcagctctaggtaaaaatgtatccacagcttctttttatttacaagtttttgaaggtaaagcaaatcccagctaggatgaaacatctcttatacagccattctattatttctttgccctgtcccacttttgtttgtaagtagtgcctttcattaggcattttaaattcagttctacacttaactctattctctcaaagatatttaatgggtaatttaaactttccttggatataactaagttctaatcagtgagtattctctattagatatttgcacttttaataattttgtgtctagtttaatgattaattttttgtctggtaaaggaacttagaaattacaaatttgatagagatttaactgtggtgctttaaactaccccccgctccccaagatgtattatgatctgtcttcctttctccaagcttgtgtcctcgtcttccctcttatgatttccttgcttacattttatgaattccgatcccttttataaagattcatacaaaaggtatagtgttgaaatataccctaggaacattaccaagacttcgctgacttaatataatttaatattaactgacacagttgtagatctaataattatgttcattgtaccagctcatcaattgtctatcacaaggtggtaagtttttaccaagtaacttcaaatctacaatgtgggatactacaaagcaaatagtcattgctatacattaaatcacaaatccaaggtgagtatttaaaaagcctagggtggaaattcagatgacagctatgttcaaatattcacttaaccccatcattgaaaatagtcactgaattagattgaatggttgtcagatgtcactgatctgaaaaatgatatactgttcacatgctggcatataatgttagataaagaggattctaaaatgttctttaaaactagtattttatgtgtcctttaagtattcagaaacttaaatagccatataatacatattttggagcatgtcagaatatatttgactataaactacttctatttattactcataaaatctagtatttaagtacaaattccaaatttaatttgttagacaagtatttcttacacaaaattgtcagtccacacaataggcctgtaaaatatttgcactttatatgtattaattctcaagtttgcagaagaggtagatcttgttaactctgtaacttatcaactatagggtctttgccaaatgattccgtgactttgactcactttatcatctgcgaaatgcattaatagtaaatgttcacttctttcaaaatacttgttatggaagatacaaatatacaaacataatctcgtattcattaaactcacattcagttgcaaggtaatataactactcttaaattgcagcatgttctcatttaaaataattttctgggtgagttgtttattcttcccatcccccttagtatacctcttgctttaagggaaattagtattgacacatttcttgtatattcaacttcaaattgagatagccagttacctattatgttcacatatggaggtctgctgggataataattatataactataaatagtactgtttaaaaatatttcttataatgtcactcaagtatcttttaagatttttattgtagctattgcttttttttttttttttttacttgaaattagtatacgtgacttgagcttaaaaagttggggctatatgggttgatttttgtcgttaaagttacatcctatattgccagataaaagatacgtaattacaaaaattcaaattaaataatatactgaaagtatatatatctttcatactaaattgtgaaagtattgaggacagtgtccatttactcaggcaatgccctctaatatatattctatataaggaattttgttgagtttagttaaaagagctactttcccaaaaagtttagtttgcattttattaatacgttcaaccagattacctgtatcaaaacttctattttgataaatttgttttaatgtctttcatgccattaaatgttcatattttcttaggattatgagacacttgtattaactgcctcaattctttattgtcaaagaggcagtatataaacaaatgaaaacatgactccattaaaaataattctcctgcaatgtatcagagtgatcataaacatatctgaaatatagaggaaatttaacatttcacttgtccataagcaatttgttgaaagtctattttttaaatttattcttaacattctatgcgtggcatatagtgagtggtcaaaaatagttaaagaatgactaaatatgtaaaacttaatcattgaaggtagagatagtatctttgtagtgagtacccagaattaaatcttgtaatatagttgaggtcaaaatgtgcttcaaaaattatctaatgtaaatttctatatctgaatcaaaaataattcttgaaatacggagataaggaagggaataaaaagctgtcattggaaatccaggtccacagtggcaatatggcccaccgtttaggttgtatatatcgacgtatttatgatttaataagaaaaagattcaatacatgcatctctcaatggaagaaaataggtatgatttatgcccataagtcttgaaattttaaacagtgtaaatcttaaatgtggtgtaaaagcacatgctgcagggcaatgaaactactttgcctttcctgtattttttatctttttaaaatgcattatatttagaaggattgtatgaatacttgagaagtttctcttgaatatggagaagtctttagcttggctacatgatggcagacatcttataaaagacatttaacatgtttaaaaagcaaattctgtttatctagaatgttggaaggaacttctcggtttatatatattttatgagaacgaaatgaaatgaaaagaaatgaaagaaccaaatagatggtggaagtacatgcttgaggtttcagtgtcaggaaggatatttacataataattttcaatgcatgggatttcccttttagttattgtttaagattctgtttaaggaaatcaactcaaacttttaaggatatttcagggttcctttcagaatctttttgtgaaattattttataatagtttgtaccatttcatatctagttaaaatcaccaagactgagtgaaaaggtagcttacccttatccccctcccttagctaattttaaaaatgcttgtattttacactgcatatgagggaacaaaagtgactccttcttaggacaaatatcaaactctgaaatgatctgggagaaccaattcctttgaaacaaatgtgagaaacgacctgctttagtctaatttcaattggctgaatgacgcaggacgtgttttcattagagcctgtagctctgaaatgtccttgtcactggttgtctaaaaaggcaagaagaggcagacaccatatattataaagatgatggttcccctgtgaatgagatataactttctgcaacttccaagttaaaaccgcaaatgcttaaatgatacacaaaactctaaacatccatctctctctgcatctaacaaaaataaaattgtatgaaaaaattcattaaagctttgtcagaactttgtcacctgtctttttctctctctcatacacaaaccacacatcacacacacacacacacacacacacacacacacacacacacacacacacgtaaatatcttacaggaatgtaactcttagttttattcatcattttcccttctctctctccttctgctctgccctaagaacttccattttcattatttgacttggttattgaaattattttcaagttacatgcccctcattctgacgtcttatttactattttctgtttgatgaaccctagtctgctattcttctttctgtaaagcaaatcaaaaataacactaacttgttcctgtcaataatctttcagaaaaccatcatatttcaggtttactttcatcttaagtttttcttaagtattcttaaatcttgaatatatcaatataataagtataaatccttttactgtaaaccatcatgggatatctaatcttagcttgaataaaatattgacgatggtagaaattacatccatgttcctgaaggaaagtgggataaaagaaaacagcgaggttttttgcctgtctcgaacaagcaaatgacgagaattgttcctcatagcccagtcatttaggaggtagagtacctggaagtaaatgctccctgaaatgattatatattaatcttagaattactaaatatatattgttatacaaaattatgtattgtaagtactagtctggcgatagaagagggacccccttaagttcttgtcctatgcctttaaaatagacagcaggagactactccatactaaagaataatttaatgtattaggttttctatgtgcaattcttacagactgcttattgtaacttgaggtgtttctaaagagttcacattttaatattctactggagtcacaataagtttccattatgtcaaagcaaaccatggaggttttctatcctccaaaattacatttgaataaagcaacttccgaagataacagtgtaaaactctgagacagcatcccatgttactttatgagtaaaatcttaggcctgttgacaggaactacaaaagccaattgtgctgcgtagtttaacttatttctgcaaaaactcaaggcatgttattacattttcacacagaatatcaattttcacacctattttggtatcagatgttttcattgtgcaaaacaggaaagcagaactttgggtaaccacagtgaccctactatttaatttccaaccatagagtgcttgtcacaacactgatacacacagtaggctcgtacattaacatacatgtcatattaatgttttctgttttgcttagtagacagatgtaatcattcacttcacacagattttaaaaggttttaatatttttaccattcagttatttagcaattagactgataattcttgaaagacataattctggaatgtgtattagaaaaaaaaacataaaagagaagttactgtatggcagggtgatgattatttaagaggaaatagtactgaattcagaaaaatgttatgacttacagctaatagtaagaaatacagcattataagagcaacaagcttatgagaattcatggccaaaacagaccagaccgtcaatgtgaggcattgaagagtaatataaatgccatgaacaataccctttcaggcatgacaaatacctccctcctctagagtcttcatggttatcaattagcatttcttacactccttggtagtttgaagaagacatgtacaagagacaaaacacaaccaaaataaataataatccttgtctgtatcatggtgtgaaatgtttattaacttggagagagagcctcttaaagctttttgtggagaattcactagatgtaattaatgaaatatcttctatccagacatagttttaaatcagaccttgtggaagcttcatttatctttgatactctgtttccctcttggtaaaatgcacataaatgtaaaatgttcatgaactcttggtaaaatttatatagctcatacatactctaatgatgtaggcatagtgaaatctgtattcagagagaactgtatagccataagatttttaaaagatggaaataaaagaagtatgcatcttaagaaattgtaaaaatagaaacaaaaataaaaattgtattcaacgtagaaaattgaataagaataatccattcaaaagtgagctcttgaaaagattaacaaaataggtaaacctatcccagtcataacaaagaaaacttagaataaaaactagacgagataaatgagaaaagacgcatgacagcagatacagaagaaatgaagtggaaactaaaagcaattttataacaattttgcaaaattctggaaaacttgattttctcgtacaatacaaatcactaaaattgagataagaataagtggaaaattagactgattacttcagaaaacatttagtaggttattaaaggtgtactgttgaagagtgtagtaggattctttacaaatgaatttaacgtaacccttaaagaataatttatatactttaagctattccaaagcatatgaaaagaaaaaaactccacaattccttttgtgatgtcaggttaacctttgtacttaacagtcaaaaagcaaagatcataaatctgtaagacagttttacttttgaatgaaatacaaaattttgttgaattataagaaatataatcacattttgcaagtggtaagcattctacaaatgttatctcttatttaccaagagctcttaaaattcaagaaggaaaagaaaactaccatatagaaattaatgagcaaaacatattaacagacaattcacacatggaattgtaataggtcagtgatacaaaaatatattcaaatgcacaaggaatcatggaaataaaagttaacaaagtgatgtatttgatcatacaaacaaaactaaaagaatcaaaaacaaaacaaaaatttcctggtgagagaagagcctattcttatacattctggttaaaatatgtaattctaaattgtttctaggaaggcaggtggaaacacctactaaaattacatatatatgtgtatatatgtgtgtgtatgtatatatgtatatagatgtatacatatgtatatatgtgtatagatgtatacatatgtatatatgtgtatagatgtatagatatatatgtgtatatgtgtagatacacatatacttgtatagatatgtctatatctccctgaaatgatgcgtatatatatatgtatagatgtatctactagagcagagtgtgtgtgtgtgtgtgtgtgtatacacacactctgatccagtatatacatcctgtgaattgttataataacagtagaagcatcagtatctgaaaatgtatgcataagatattggccaggtgtggtgactgctggtgggaatgttaatcaattctgccattgtggaaagcagtgtggtgattcctcaaagaagttaaaacagaaataccattcaacccagcaacctcattatttggtatatacccaaaggaatataaattgttctacgataaagacacatgcacatatatgtttattgcagcactattcacagtagcaaagatggggaatcaacataaatgtccatcaacagtagactgattaagaaaatatgctacatatacaccatggaatacaacccagacaaaaataagattgtagcaacatggatgcagctggagccgttatccttagcaaactagtgcatgaacagaaaaccaaatatcacatgttctcacttataagtgggagttaggctgggcgcagtggcttatacctgtaacctagtactttgggaggccgaggcgagcgggatcacctgaggtcgggagttcgagaccagcctgaccaacatggagaaaccccgtctctactaaaaatacaaaattagccaggcgtggtggcgcatgcctgtaatcccagctacttgggaggctgaggcaggagaatcgcttgaaactcgggaggcggaggttgtggtgagccgagatcgtgccactgcactccagtctgggcaacaagagcgaaactccacctcaaaaaaaaaaaaaaaaaggggagttaataacaagaacacatggatataaagtggggaacaacagacactggagcctactcaagagtaaaaggtgggaggagggagaggatcagaaaaactacctatcaggcaccatacttattacctgggcgatgaaataatgtgtacattaaacccccatgacacgcaatttacctatgtaacaaacctgcacatgtactcctgaacctaatataaaagttaaaaaagagtagctgtctgccactgaatacaattctgtccctgaatataatatctccaattcccaatcagttaattaccccctagtgatctgaatgctttctggcatgctttctccacctgatacttttcttcattccaatctattttttctttacagatttaatcaatactgagtacatgaatatatcttatgtcttttgcttatcttttcacaatgttacttcctttttcttaccccttgggcttccgtgagacacagttgcctacctaattgtttttcctgtggatatagataaattttattggaaaaaaaccatgaacatttatttaggtattatctgtggctgctgctgtgtgtgtgtgtgtgtggggggggggtgcgatgtgtgttccaatgacttattttttattgtggtaaaatacaaatgatgtaaaatttaccatataactattttttattttttaattagcaaaaaaaattgtatataccatgtagcatatgattttttaaaatatctagatgttgtggaatgcttcaagctaataaacatatacattaacttatatgtttatcatttggggttgaggacacttaaaatctattctcttagcaattttcaaaatacaatattgttattaaccaaagtcagcatgttgtacagtagatctcttgaatttattcctattaaatgtaatttagtatcatttgaccaacatctgcctaaccctcctcctccaagctctatcccctgctaaccaacattttactctcaattctatgagctcaacattttaaaatttcatatacaagtgacatgatgtaatgtttgtctttctgtgcctggcttatgtcatttgacgtaacgtactctagattcattaatttcattgcaaatgagaggattctctgctttttaagtccgagtagtattccagtgtgtgtgtgtgtaggtctgtatacctgcattttctttattctttcatctactgatggacacttaagttgatttcctatcttcgctattttgagtagcactacaatatacattgaagtgcagttatttctttgacatattgatttgtttcctttggaatatatacccagcagtagaattcctgaattatatggtagttttatttgtaattttttgagaaacctccatactgtttttcatgactacaataatttacatttccaccaacactgtgcaaagattcctttttctccacatctttgccacaacttaccttttgtctttttgataatagccattctgtgtgatgtaatatttcattgtagttttaatttgcatttctctgatgattagtgatgttcaacattatttcatttatgtgctggccgttggtttgtcttcttttgagaaatgtctattcaggttcattgccctagatagggtttgaggtatcattttttctatttttttagtgtataattcagtggctttaagtatatttctgttgttgggtagtcatcaccgctatccatctctagaatgatttcatcatcccaagttgaattcatactgattaaacgattactctccattttcacctcccctagcctttaataacttccattttttctctatgaatttggctattttaggtacctcatataagtagaatcatacaatatttgtcattttatgtcttgcttatttcacttagcatatgtttccaaggttcatttatgttgtagtttgtatcagaatttcattcctttttaaggctgaaaatattccgttgtatgtacataccacattttgtttatccatttatctgtagatggacatttgggtgttctcacattttggctattgtgaataatgttactatgataattggtctaccaatatcttaatctctgtttttaattattttggttataaacatagaggtagaattgctagagcctaatggtagatacttttttattatgtgaccttctgttgtgaactttttgacactgggggggtagtaccttactttcctttatcaggtctgagcccagtacctgaatatagtggaaattggaccttatgagaccttttatgaggacaaggaaatggaggaactatcttcctgcttacacagtgacaagtcttatgacagtggataaggggttactggaatctaagttcctattacttgatctaagtctccccagagtcaggtccatggcaacccaaaacgtatctaccagcagtgcttcccgcagtatgagtgagtatgtttcctaaaaatagcatattctctgcttaactgcttgagtctttagtgctatatcatctgattgtcactatcactagaattaagtttcatgaaagcagaaggtttttacttttacatgctcttattacttcattgcctggcagatagccaaaaggtacttgttgagttagtgaatcaatgaatcaatagataaattcatagtggcttttccttatggaggaatttctctcctctactgccatatgaggaatccccagatgatgatgcagatgatgatgctttcttattcttgaatgatcaatctccccttcgatgtagtaacatcttataaaactaaaatacgatatcatgaccaagatgtcaacattcataaaaccaccaatagtattcagattttcccagctttactcatatttatgtgtatgtgtgcatgcatatgtgtgtatttagttctatgcaacattattacgtgtgtaggtttgtaaatccaccatcagagtcaatatgcagaacagttccaccattacaagggtccctcatattgcccttttataagaacattcagctaccccacatcttactcccattcctgacctctgccaactgctattctgttctctatttctgtaactttgtcttttcaagactctcatagatacggattcatacagtatgctaccctttcagaatgactttttccccacttagcataatgcccatgaaattcatccaatttgctgcatgtatcaatagtttgttcttttcattgatgagtgttattccatggtgtggctgtactatggtttgtttatctacccctgagggcatctgggttcccagtttggggctattacaaataaacgtagtatgaacacttaggtgcaggtttttgtgtacacatgtgttttcatttccttgagataaatgctcaagagcccaattaccagattgtataataagtacatgttcagttttgtgagaaactgccagactgttttccaaagtggctatatcatttgagtttccactagcaggggttgagtcatccagtttctccacaccctcaccagcattttatggcactattttttaattttaaccattatgataaatgtgcagtgatacattattgtggttacaatttgcattcctctattggctaaaaacattgaacatcttttcatatgcttgcttttcagatgcttgtgtttaactttactccaccttaaacatttgaggagtgtgaaggacaggagacacagagatttgccttgattaaggcaaataaaaccctgccagattttcatttccaaacacagtcctagacagagataagagagctggcagtttgctccattgtttattagagacctaacattcattctaaaacagaggcgttttactaaaatgcagtcagccttaattataatggcactccttggagctaggtggaagtactggtgaatttttctgagttgtaattccatactagaaagcatatcttaattttaaacatactttatgacattttatttggagatactccagttgacctctttaatctgcagtaatctattcatgtgctgaaagtaaatatatttggggtgcttgtttgttatggaaagtgattttacacatgcattttgtttaatttttagattattttcaaaaagcttcaatgctaagtctctgaaaatagctaaatgcaattaccttcacgtttttattattattattattgcaactaggcatttggtctcttaccttcaaatgttttacccctttctttaacaggttgatttagtgaatattggaagtactgacatcgtagatggaaatcataaactgactcttggtttgatttggaatataatcctccactggcaggtaagaatcctgatgaatggtttccttttgggtaacattaatcttgttttttaatttttacccttgacgtgtgaaacaaatgtgtatttctaacaataacaaaccctgctccatagtgctgctttttaaattgacactaccatgtcgtctgaaatgttaaggatcatcacggtataaaataggttctggtacatttacaggaatatttttcaaaattttatttcattgagtaagtataaggtaaaaatacaaagtcccaatcataggtgagtaatttttttcacaaatgtatgttctataacttgtctataagttaatttagtatgttttattttaatcactaccaaaggaatgaggctttctcagtcttgggtattcttaacataaattattgccaataaaagattagtagaatatgggtatctctatcaataaatgtgtgtaatacatacaaactccataatgtgatttggaaattatttttaagtcacctgagcatagggtcttccgactgtctatttgacctctgcaaaatgggttgaaggatttgtggaaaagatacagacacacacccgtgtgtgtgtgtgtgtagtatatatgcgtatatatataatgtgtctatatatacacacatatatacaatatgcatgtgtgtatatacacacactcatatccacacattatatatgtatatatatacacactcatatccacacattatatatgtatatataagaccaacatgaacttatatccactaatattatccactcattgtatacatatacataatagtataatcataatatgtatacataatcatacatgaacttatatccactaatattttccactcattgtatatatatacgtaatagtaactcgttatacacatatgtataaatatgtatgtgtatatatatataccaacatgaacttgaatttaaacttccacggttaccatcttagtggcatttggtatattgccacccctgttctgggccatggtcccttcactatcaaaagagtaaaaataaaaataaatgtgtatgtatttcttatcacgattaagtgggagaatatctgcaaggcactcagtgtagtataccacttttatttgaggtgtatcatatgacttgtattgattgcttaaagttttccactcatttaaaaaatttggaggctgagaaatgactgctgtttttactggtcgggattacttttttataaatcagcgtttttgaaatgtaattgttagaccatcaatgtactcattctaagtgtaaaattcaatttgcatcaatctggtttagttctggttcttggtagcctctcaaactattttgagggatgaataactcccccccaccacgttcattaaaatttgcaggatatttacagagttatatagccatcatagcgatctaattttggcacttttccaccaccttaaaaagaagtttcttctccatttacagtcatttttcactcccaccccagccctaggcaattgtcaatctatttctgtccatatgtatttgcctttttggatattttatatcaatataatacatgttcttttgtgtctggcttcttgcaatgagggtaatagttcagatccagccctattgtagcagatatcatggcttcattcggtaaacttgaatttttttattttttatttttatttttttttatttttattttgagacagagtcttgctctgtcgcccaggctggagtgcagtggcgcgatctcggctcactgcaagctccgcctcccggattcacgccattctcctgcctcagcctcccgagtagctgggactacaggcgcccccccaccacgcccggctaatttttttttgtatttttagtagagacggggtttcaccgtgttagccaggatggtctcgatctcctgacctcgtgatcctcctgcctcggcctcccaaagtgctgggattgcaggcatgagccactgcgcccggcttgaattttaacttgaattgtagattgctcttgctcagagtcaaatagtgagtagacacaaagagtacctattaaattcagcagccatgttgctctcctaattggcccccatatatttttattccaaattctctgaacaggcttaatgctacttcacaacagtaagcggggagaggggaagagaaagagcgggaattaatatgtgctggcaacaaagaatagctcataggagccttaagtgagcccaagttggccgattttcagcccgttccatatagtgatggtgtcaaatagaaccagcaagcaacataccgcatctctccccaaactgcttttcatatgttgctcagtacttctcaaaatatcttgaggaaggaacacttttcccctaatccattgtatgtaagatagaataaaaccaaagcgttacaaaaataagatgcccaacacccatgcttcctcctttattattaaatacattagacataaatggtactctgtaaaatcgctacataagtttcttgatgcactctgaattgttgactttatcttatggcatagtaacaaataattcctagagtgaatccagtttgcagatcccgctttgcgtaagacagatgtaagttttgacaaagccagcagaagaactcaagcatgcacagagctccaaaaggcactctgaactgtatttattgtttatactacttcttatatgatcttaccatttttaaaaatatcctgaagccctttccaactccatctgaactagtccaagataagctttcaagactattatgtctgataatttcttcacttgcttgcaagttgttcatttattattatttttttattttttatttttgagacagagtctcgctctgtcacccaggctggagtgcagtggcgcgatctctgctcactgcaagctccgcctcctgggttcatgccattctcttgcctcagcctcccaagtagctgggactacaggcgcccgccaccacgcccggctaattttttgtattttgttcagtagagatggggtttcaccgtgttagccaggatggtctcgatctcctgaccttgtgatccgcccgtctcggcctcccaaagtgtttggattacaggcgtgagccaccgcacccagcccatttttcattattagcatgtggaggcgcttttgcaatgaggaatatcagaaggaatgctttttaaatctttctttgtctgagacctctcttatagcctgttgtttttcatttatgcccttgaatcaccatatccttgagactgcaagactgtagactcttcccagcctctgcttacttatctcatctctcttatatcacactgccctgttctaaaactattaagcacactttgaaaaattatcttgctcagtgttcatcataatccagtgaatctaaaaatgtgtttttcttttttttttttttttttacaccaacattacatattttcttcctattaaatggtagaagcccttgaatttcagcaaagattaaaggacattttggtcaacttaatgtacattctagatctatcagataacgagcggcatttacagatagaaccatgttggcccctttttctaatgcaacatactatgttattaatagtgccatggaggacttctcattgaacttgtgaaaactcaggaatgcaaactctgttttcctattactgtttttctactgtccatctcaaataaaattgctagcctaaaacagtaacgcatattttgtaacataggcaggtttgaacaaaattgcaaagcatataacatgtgtttggcatctttttcttccttcttaagtgcaattctttttttttcggagtgctaaacttggctctggcaaccagctggttgtaataacaaatcttgctaacagtggtgagctatcagaagtcaggtccatacttttactggacaattcaagggatgtacttaatggcaacgctaattcactttagaatgttcatattattgatacaatttgcaattacaggagaatgatgacgttcgcactgctgaaagccatccctgtaaattcctgcctaccaagtcacttctgtgcaagacagttcttgctctgctcttctgcagagcttcacagaaactatccttaccatataagattattcctaccctcttcatttctattcctctgctgcaacttcttttaatcacagtctgggttctggggagtagacttcggagttgagtttggcaggcagcatgtttattaagccatgccctggaaaaaaaaaaaaaaaaaaaaacacctgtagaagggcagaggtgacaggagtggaaagaggaagaactagagctgtgacgtagaccctatgacacgcttattcaaaccccatagacaacttgcagctaggatgacccctcagagttgtctcaaatggggttaaaatggctgagtgtttatactctgccccttcatcagtcaatagtagtgggttgccctagagagggtgtgacattggctggcaggactctgcaactcaggtggtacctgagagaactaacaactagaagctgcctgaccacagctggagcaacaagcccttccttgaaggtcaatcttggtggtgcacctccatgtccatcatgccttcttggcccagttaactcctagtcatttttaaaaatcactgctcaaagacatttcaacttttttccttttaaaaattgatttatagttgtatgcgcgcacacacacaaatacatctgtttaaattgagcctcctttagagacagtgagacctgaggacgggacagttttctgtttacaggctcacctttggggaccagctcaatgattttttgataactgccttttatgtaggaaaaggagacatgattatcatacattgccctttattatttttttttgtctgagcaacatttgcacctaagtagaagcaataacagcgaggctgaggctgataagctgaattagtgacataatgatgctataaaggagttttggattgaatactttgttgtcctttaacgttatgcacatagagggcagactggccaagcatttcacaaatgaatcacattcatcattggaggattgcttgattattgcaaatccattaccaccattaagccactatctgctgattccaaccgtaatttagcacaggacacaaaatacacctcctgcagtcactgtacataaaggttgagcaatttataattttagaatatgagacaaattacgtaattatttgacctgtattcactgagtaactgactaaataagtaggtcaagaaggaattaggaaaacttggataatccactcctaaataataggcttagttatcaagggattgtgacagatacatgcaaagatttcatatctccgaatcgttactgtgtttacaaagcatcatctcaaatcttttaaaagtatgttaaaatgagatttagtagtatatcctaaaatttgcatttactttttaataaaaagatgactaacattggagatgttaaaatatgcatttaccccaaaggcatttgttaacttctatatggatgaaaaaataaaattgtcatatttagaatgcacaataaatattcatcatctgatcaaatgttgatagtatatgaaccttaaccttcccagaaggaaagtgcttagtggtacagactgatcacttttacatagatgtcttcttccagcatctcataaggggcttatatttaaaaagcagtctttaataaataataattctttaataaaagatgtagacagttttttctatgaagcgtcactgcattcatgaaacttagaaaaaatgcttagaatggatttctgcatcagatgactcagaagaattaaacttgataatctgttgaataacatctgcacatgcacgaagcctatgagacaatcaaatacatggaaaccaagtaatgaaaatagaaccaaggctacatatgtacacctcttagggataaatatttccttcctttgttgttttttttctttattttaggtaggcaaacatttctgtcttcttttcagttcagccaataaatatagcttgcgttaaatgatggtatgaaatcaggggttttatctgaccatattttgtactttgatcttacactaaccttgcatgtaagatacacagaaatgaggcctagaagaggttaagcaacttgtccaattaccacaattaatagcaaaggcaaaatttgaacatatactttaaaaaacaattatctatagtattcctcctatccaaaaagcgcttttatatcttaagtccttggttaacaataagtctaatgttttatacactgtcttctctagcttgttcattgaaagctagaaggtgagcaattctataaacagtaaatgttgggtctaatatggcagaatccaggagtaatagtgaacacattcagtaaatggtatggcatagataccaatgaatcagaatagactcctagcctttgagaatagacttaacttctggtagaatctattatgtctcattactaattggccctaaaatttctatttatcactgaagatcaaggacattcatatttaagtttgcatggttcttgctcaaggaatgcattttcttatgaaaatttatttccacatgtaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcagaaaaagaagatgcagtgaacaagattcacacaactggctttaaagatcaaaatgaaatgttatcaagtcttcaaaaactggccgtatgtactttctagctttcaatggtcttataaaaacccagtactgtatattatcactattatttagtctcttctatgctattgaatattaaatgtttatttttgcttggatcatagattattcaaagatgttatattgctacttttctgaattaaagtgggaaaaaactataggtggattttcaactttgtttttcaaagttgtactcttgataaaacatagcataccagaataagacttcaattaaaattaataaagtaatactaagaaatgtctgtgagcctttcataaagttctaagcagcatagttctaaaaaaatagactgacgttgattctcagaataatatgtgagagttacaagcgacggttatcctgacattgatggagtttaaccttagtttattataaaggggtacctgagactgggactgggtaacttatgaaataaagaggtttaactggctcatggttctgcaggctgtacaagaagcatgacaccagcatctgctcctggtaagtgcctcaggaagcttacaatcatggcagaaggagaaggggagccagtgtatatcacattgcaagagtggaaacaaaagagataagaggaaggtcccagactcttttaaacaaccagatttcatgtgaactaactgaatgggaactgactcatcatgaaagggattgtgctaagccattcatgagacatccgccctcatgagccaatcacctcccaccaggccctacctccaatgctgggaatcacatttcaacatgagatttggagaacagagatccaaacaatatcacctagtttttcaagcaaaaaaaaattaaagcctatcaaatgacattgattataaatacctcgagtgttttgagaatgagatttctttggcaataaatggatttcagaaaagacttcattgaagcatttggtttcagcaggaatttccaagatttaaaaaaaaaaaaaaaaactctaaagtttctcttactctgtgaattttatcatttctagtaaaagaggccggtctgatactatgagtttaatttttcacgtgacatattctactttatgatttcttaaaatttttgatagatttgattaaatgttcatttgatatgaacttttataaaacaaaatggttgtaagtagtgttccataatttcacctttattattgcattgtacttcataataatgcaataatttctaaacttaagtaaatttttccactcattttaaatacgtaccattttaccagctatttatttgtttcatacattttttttgctccataaatgctaaccctcattggtcttttaatttaaaatagattcacttatgtattacttgttattacaagctagcttattattgataagaaattattgctcaaagaatatggactttattaagtgatgtgactgccgaaaatagagttcagaaaagtaacctgtatatgtttgaaaacacgagtgcaaaaatatcagctgtatttgtagttttggcctgcagctgatggggagccattgagagtttgcaaaagaatcatatttgcatttttgtaattctttttggtaggaagatgtttgatggtacgaggactaatcagaagacctgaactaagtagcattgggcattaagataagaagagaaacattagaatgttaagatgtgatgaatgaaacttgtgataagaggcagaagtttgaaatggttcctagacatttcatttgggtgactgggttcctaggagggttattagccctaacaggagaatagaagaggaattgctggaatgacaaaaatgataattatttcagatttggatatattccgtgtaaaatgtctttgagacatccaagttaaaaatcctttccattaatcagttggtttacacaactagaatctcagaaaatggttcatgactagttattgattcagaagcaatcaaaatgcttctgagggattgtgtagagtgacacattaagtgaaacgaatagatttcagggaggaatgtctacaatcaaggagtaggcagaggataagatgttgaccaaaagattgagcagataccacaaggggaaagtggtatcacaaaagtgaggagaataaagatttcaaaaaagtaggaagtggtacacactgtcacatgccacagagaggagaggataaattcatgagggattctatcatatctagaggaatggatgcatggattacatctccttaaagcagaatattccttacaaacattgttcttctcaggcaaaatgtgaatcctttcagtaaataagtgagtgaccactgattatcaaaatgcagtcatgccctctgattaggagcgaagatatattgctagttaaatacagaatcatgtgcttcagacggtcaatcataatggtgatggtcagtcatattctgtgtgctgaaaaagtcacaagcctgcccagattcaaggaaaagggaattagatttcatttcctcatggagaaacaccaaggtcaagttatagcaaagcatctgagatgaggatattttacagccatctttggaaagtaccacatgccagaatagtacagttattttacatgatgataaattccaaatcttaatatctagtcaaagttcctgcatatattgttgactagatttaccaatcaagaaagttgttcttaggaagccacaaactgacaaaatccaaatatgttaaagctagatgagattttgcatctcatctagtgtttcttcaatctcattacacatgtaaagttcattaggaccatctactcagtttgtttccaagagaaaatcgagatcaagaaaaaacacaggatctgtatcctacaacattagtatcagacttaaaatgaacactaagacatccagactcaggtccaggcctttcaatctatttcagtagtcctcatatcagttgattccttggaaaaaataactgcaactgagaactgtcatttctaacaataatgtgcctctatgttaacatttttgtgagcagaaatcttggctagcctcagggccataaaaatgctcttttaagaaagtcaataattttccaataggattaaaatttgtgttatgtcaccttgcttgtgaacaaagagaaaatatgttttctataggtcttgtcatttgatagtttaagccaattaacaaaacctgacagctggtctagaatttgaggtaaaattcctttgctgactcaggcagtgaataagaatttaatgttcattaaaatatgtcacaatctgagacccaaaacaggtaccatctgtcaccagttttcactacatgtctaggtatagatacactgtgctaaactctcttctctttacaataagtgtaatttgtttcaaaatagtatcactgataacccatgggattgtgtcctgcttgccattgaggtgggaggtggggattatgacatttaatttgctctagatctttgggattcatatccaaatcatgtagatctattattttttataatcaaaactgatttaagttttaaactgatttggcatcagggataaaaatgaagggaaagaagaaacagtagcttttatgaggtgaattataagacttgtagaatcacgtaaattatcgtgggaagatccaagtcaagaagaaacctgttcctgagtaaatgtatttctgctgtggggactgttggcgtttgctggggaaggacagctctggggaagcagggtgatccaagagattatggtatataagggctacagaagtacttaggaattgaagatattctcaaatggctgtgggatcaaaggacatggatgaagtgctcatggtaactgagcaagttcctgtttgacttgctacctttacctcaactcctgggatggccctcaaataattaattcagacaggatcaatgcttctcaaaatgtgttcccccgaccggcagcatcagtatcaaggaaatttgttaggaatgcacattgttaggccatcttcagacctactgatttagaaactctggaagtggagcctagtcatctgcattctaacaagcctttcaggtaattctgatgttctttcaagatgagaacctctgtaatagatcaacctcccaaagtacaactggtgattagaatgaattggagcacatcttacatgtagataagtaactacacataatataggtggaaaactcaattttgccaatataggagaaattgtcttggcattattctcttatgcgtattcctgatgagagtgaggtgaaggtttcctgggccttttgtaaggatacattatcttttcacttcaaatcatcttgaacagcttatctgtctcttctccatatccactactgacccagtctgatttattgactgtaccttcctccctaccttggaggtaggtctacattcctggcttctataaaaataaagtctgtttattcttttactatcccagctggcctttgccttgtacacattctctagatcttccttttgccacctgaattttctagagctctatgggtctctggcactcatagacctatggttaattattgatatgtagaaatacatattttatgcaataattagtaacaaatcatagttatttaatatgcacatgtaagacctaagcttaaaagaatcagcatcaatggatagacaggacaaggtaattctaatgaattctatgatctaatgtatctggccccatcatggattttctttcttttcctccctcagttaataatcctgggggagttctggaactgggagatgactactgaaagacagaaaaagagagagaaactgagaccaaacaactaatctgccatcatcatttttgatactcatatctaaaatttactaggtataagtctgggttcagtgtttttgtcatacagacatataaaaattcatttattcaataatcacacaatgtaattataacattgattttactttaccttgagtgcacttttttcctaattggatttttttttttttcttgagatggagtcttgctctgttgcccaggctggagtgcagtggtgtgatctcggctcagggcaacctctgcctccctggttccagcgattccttgcctcagcttcctgagtcgctgggaccacaggcatgcaccaacattcccagctaattattgtatttttagtacagacgaggtttcactatgttggccaggctgatctggaactcctgacctcgtgatccgcccgcctcagcctcccaaagtgctgagattataggcgtgagccaccacctctaattttatttttaatggtgactttcactttcatttttgtaatgcttaccaaatgtttcttcatgtggcttaataataaaacaggaggcttattttcatttgtttaggtaccatgaggttactcataggtttttattgcaatcctcttctttaaacataattctcacactcctcttctgacatgtttccaaatcattacatattttgtttaaataatgggtagaccattcagccttacacatatggctatttaaaatagtttctaacattctgagtaagtaagtcaaagaggattgtacttagattttttttttatttttagatttgtgtctttgtgtatattgtgcctctttccatagtaaagaaaaaaaatgacactataactggaggaatatacattgaaattcaaatatggctctcagcttgggacaggtagcatcaacctttgttctagtactaatgcaaatattcacttaaatttaatggaaaactaacaagtgaattaaacaaaatgaatatgcaaaacctatctattgggctgggtatggtggctcatgcctgtaatcccagcactttgggaggccaaggcgggtggatcacttgaggtcaggagattgagaccagccaggccaacatgttgagactcctgtctcttctaaaaatttaaaaattagctgggcttagtggcatgtgcctataataccagctactcgtgaggctgacaggagaattgcttgaacctgggagacagaggctgcagtgagcagagatcatgccactgcactccagcctgggcgacagagttagactccaactcaaaacaaaaaagaaaaaccacctacctattgctaaacccccacaccgtgagttttattttgatttgaattcagtgtataatatcttaatttgtattttggtctattgcattctttcaaacttagaaaaatactgaacttattgttaaggaaaaattagagatgaaacttaaatcttgctttgtttccccttaaaaatggcatgaagactgaactataacatactccaggtgaagcagattctgagtaaaagacaaactaattgaaggagccactagagcattctgcagttcagagctatcaatgcaggtgccatgccaaaatgggctacttagattgtccttttcaggaaggtgtattgactgctctaggtttggggcactttgcttcatgggcaattggtgcatttgtgtcatgacaatttgctctgtggtatgttagttcttaaataaacttacatttgtttcggaaagacaggtatcgcgatttagtttacattcattgtatttgctgccaaatatggggttgttaagtggctgtaagataattttctcctttatttctcttccttcttctcctttgtttacagattaagtcagggagtaatgttcagtacccaggaattgaatttgtctgtgtatcaggcaaagttactgagtcaagtaaaagaaaaactgccctgatttactgatttcacataaaccacttattcctttcaaatcaaccaaagggagtttgtaaccctccacagctcacaggaactttggaaatataaatggtataaaaattgcttcataagacacataagtatttataaactctgaaaagagatgctgaagcatttatgtcatgcccagcgacttagttcttttacttaatgggctctacaattagttttaaaaaataattactcaaataaccagatgttaattgattaatggatgctacaaaaattttatggtcagtaaatcacataatgagattttatctccaaataatgaaccgaatgttaaaactgtggaaacaataatattgtaattttatccaaataatcacagcatttcagaatggcaagtttccttagccattctcattttctcagctcactagcttttcttcagtactcctggtacctgattgtcagttttcgtttgaattccgtcaggaattaaggggaaatccaagatccgtgccttctaatttccacatgttgatctctgttttgccttttgaagcaatattaccttttcacttggattttcttcaaatatttcaaggtagctcttaattacctctagtaggtctttattctacgtttgagtttcttttctcttcttttctcttcaaacttcttgggataattagatagattataactttctacctctatttttctgaacttttgatcctttgcgggcacgattgaaatattttcttatctatgcaaatgagcaaatacacgcaaaagcagattgaactatagtggtgtatggaatgcaacccaggcttattctgtgatctttcttgttttaacaggttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttagtgataccaattatcatgctacagactatctcagagattttttaaacctgcattaagagagtgacattataaccctacaaaagaagcaaccagattagtttttgccctgtgtttagttaaataaaaacatgattcttttgcctgtcttgttgttggagaatggtggtgaggtagagtgctaattaactgaacttgttactgccctagagtgaatttcttccagcccaatagtaacggggaactgagtgacttagagcaggcgaacaaaatgctgggaactgtataatcacagtctaaccccaaatcagagattgctagaaccacgaggaacattagccaactccgttttactcttgagaaaaatgaaacttagggaagaaaagtaaatttttcaagagaagttagtggtaggagaactagggttcaggtcttttgatttcttggaaagttttttattagtgtagttaattatctgactattgtaccttttctgccatagactgctgatttcataaaattatgaatgtggcttagttatactaacacatacgggctgtagattatgaaaacatctcagctacatttggggtatgtggttttattataataatttttaaagatttagtcactaaaatggggtatcgttaaaagttgaacctctttttgtcttatgtagttggatggtagaataatgagtagtcattcaagatataaacattatatataatagtatttaacatattctgccacatagcctggcattataaggaataactttactcaaaattcatagctcaatgcacaggcatacacttccatattcaatagattttaggcaaatatttcctctatattgagacaagtacatggaatttgttttcttgagacctgacatctgataagtagcacttaggaaatgccttttggagacatgaagtttgtagtattgcctccaggaatacaatttaagacagcgtaataaaccagcctatatgattttcaatcacagttcaatgttacttttaatccaattttacgttaaaaaattataatttgaagaaatatgaatataaattgtaataatttcccacacaatcattacataataaaaactccatttgttttccattaaacatactttagcaattaattgacctaatagtagttttagtactatattatgattcctcctgttttatgtgatctgcccatggcttctttgcaatacattggtatttatgtaataaatacatgagacattagtcaatttgatactttttaacccaacactgagagtattcccatatgtacccattgcttccacagattattgctgccataaaatggtcagttgccgtgttaagaaagattgccattatttgataaagaaagttattttgacgtgcatcccttttaagggacatgtttagggagctgtaacagttaactgtaggtcatcttctagttcatttgcattgcatggagtggttctcaaacttgagtctgcatagtagccacctgaggagctaattaaaatgcatattcctaaacattttgctcagaaaatctcatccataagctgtgataaggacctaaaaatctacatctttactaagcctttgatacaatctgcagaccatagaggggatcaacatacactgggatctacttgaggtgggagggtgggaggaagtagatgagcagtaaataagactattggatactgggcttaatacctgggtgatgaaataattggtaagcaaacccctgtgacacacatttacctatgtaacaaaccttcatatgtactcctgagcctaaaataaatgtttaaagaaaatagacagtgatatgtgtgtgaatcccaacattctggttttccacaatgctccctgaaatgtgaaaagggagagcttcttgggaatacactatataaatatgctcattcccttggaatgggactactttttgatgaagtttgtacatgtcatcgaaatattactgatttgattattccaattggtagaaaagcatttgaagccttatttttaattccctagaaattatgagaccaccacctaggcaattgacgtgatgtcttccaacttgtataattctataataaaagaatactggttttgatttgcatggttctttatgaaataaagtccaacatgcattacagcatgtatctcttcacttgctcatagggatacaatgaagataaaatggaggcatagacaagaaagcatttgaggggaaaaaggttgagtttgatatgtaagtcatgtagttcagtgtgtctggagggctttttgtggttctctatctgcttttttttttttttttttttttgagatggagtctcactgtgtcacccaggctggagtgcagtggcacaatctcagctcactgcaagctctgcctcctgggttcacaccgttctcctgcctcagcctcccaagtagcagctgggactacaggtgcctaccatgacaccccactaattttttgtaattttagtagagatggggtttcaccatgttggccagggtggtctcgatctcctgaccttgtgatcctcccacttcggcctcccaaagtgctgagattacagacataagtcaccgcgcccggcccactatctccttttaattttattttcaaacagttacacgctcctattgtgggctagaaataaataaaaggacttaacatcatgtaagttgttttccagaacactaagcttgagtttttcttaagcttatgtttcagttttctctcattgcctttccaaaaattatgctgtcatgggattgatccaaatctttgctggctgtttttgagctcacaggaaggtagaaatggagctactcaggaaaagagaaattaaaaggaggtaaacagagacaacagcgaaatagtatcatataagagcaactgattttcttttatccatgttaaattgaccttgattaaaattacataaggagaattccaagaatatgagctgtaaggttgtgactttgaagaacaaagctcacttgtatgtacattttctataatgattgtgggagaaaaatgagtttcattaatgactactcacatgatatactcaattgtttcaaaaattcttttaaataattagtataaagaatgagcaaagttctcataatggttaaaacctattgtgaggcagggtgtggaaatcgtgattgagatgacaaggcacccagttgtactcatataaagaacactgcttgcgcgtatgattgctgttcaggtcagagctttgaggcatttttgaccttttgaagcagttgcatggcaagagatcaaaacgtgaaaaaataatcagctaggaggactgctctcttgcatttcaaactcagatttgacttgaataatacctggacacaagctgagggtatttaagttgattagaaggtagcctaagaagatagaaaatactttttttctaaatgttggagagataataactcttgctatctggaggcttacaatgagaaaagagggcaaatataccctggattgacttctttaaaaactcaaatgatcatgattccctgtaattttttataaacatacttgtaatttgtgcagttttttctaattgccttggccctgatcgatatatattttatcttgatcataattatgaaatacgatagtgacgaattccatcaacatttgcttgtctggaaaagattttattcttccttcacttatgaagcttactttgtctggatatgaaattctgccttggaaattcttttctttcacggtgttgaatattagcccccaatctctactggcttatagggtttctgctgagagatctgctgttaccctgatgggcttccctttgtaggtaacctggcctttctctctggctgtccttaacattttttctttcatttaaacctggagaattgtatgattacgtatgttggggttggtctgctcagtatcttgcattccctgaatttgaatgttgggctggcttctgctcagtgagtatcttgtatttcctgaatttgaatgtttggctggctttctagattggagaagttctcctggatgatatcctgaagtgtgatttccaacttggttccgttctccccgtctctttcaggttccccaaacagtctttgcttcagaatttacataatcccacatttgtcagacgttttgtacattcatttttattcttttctttttctctaatcttttctgcctgtcttatttcagcaagatagtcttcaagctctgagattctttcctctgcttggtctattcaggtattgacaatgtgatttcattgtggagttgtcgtattgcgtttctcagctctatcaggtcattcatgttcctctgtaaactggttattctggttatccgctcctgttacgttttatcgtggttgttagcttgtttgcattgggttagaacattctcctctagctcagggaagtttgttattatccacctttgaagcctacttctctcaattcatccatattagcctcagcacaccatctcacgccagacagaatggtgatttttaaaaagtcaagatacaacagacgctggcatggtttcagagaaatgggaatgcttttacactgttggtgggaatgtaaattagtttatccattgtggaagacagtgtggtggttcctcaaagaactagaaccagaaatacccagcaaggccgttactggatatatacccaaaggaatataaatcatcctattataaagatacatgcatttgtatgttaattgcagcactattcacaatagcaaagacatagaatcaacccaaatgcccatcaatgatagactggataaagaaaatgtgatacatatacaccatggaatagtatgcagccataaaaaggaatgagagtatgtcctttgcagagacatggatgtagctggaagctgttattctcagcaaactaatgcgggaacagaaaaccaaacactgcatgttctcacttataagtaggagctgaacaatgggaacacatgggcacagggaagagaacaacacacactggggcctgttgctgggagaggaggagagcatcaggaaaaatagctaacggatgctgggctcaatatctacctaatgggtctgtaggtgcaccataccaccgtggcacacatttacctccataacaaacctacacatccaatacgtgtaccctggaacttaaaaaaataaatgtgatagtaagaaatttattataattaatattttaaaatataatgtatgtgatttgaagcattactttcctcatttgactgaaatcacatgtgctgttgaaagggtatattagtcatatgctttacaatttggtatgctaattgtaattatcatattacgccataaattgtaattactgtatttaatatgtaatttatattaagtagtatataccaggtgctttggtgtaagcatatatatatatattttttttttcaagcgagtctaaaggttttgtagttttgtggatttttagtagaataaattgtcttctttctcaggaataaggaaagttgtatgacttattaaggttcaaatatctcattcccattttgtgaatattttgctatattgctaacaacaatttttgcaacattctcaactgtgagcacctctttaagataaaatacatatgctcagaatttgcctcttcttgtacatggcagttcatgtttatgctgtatatgtttgtgcctacattcaaggatgcccaaaaagagaaaatgattattatataattatgtgtaccttctatatcatctatatcctgatgagagatttattatgtgtgctgccgaagcaagcacctgatgggagatttaaaactcctatcaaatagtaatataaaacatagctgtaaatgataagccagtgctttttattatacccaaaatgcaaatagaaatatgccaatgtaccaagatgaaaatttctttacatgttcttcttttctgagttaattctcattctttaaagatcctctattttaacccttcataaaatattttatgttcacgttctggctgtacccattctcagagcatcattttgtagacctctttgtacaagggggatatagttgcaaatggtttgcctctcttcttttttggccagtaagtttaattaaaaatactctaaggctttttatttaaaagaccttttcattgcttcctgaaagctctccacgactagtaagcctgatgccaattaaaaaagaaaataattttttaaaatctggaattaaaataaaaataccttacttattttgtgtttccttcttacttaaggtcatagaattaactcccttaaatttgagaacatgttttgggtaattcctcaggttaaagttttattagaaaaatttgaagttgaccgagtgtggtggctcacacttgtaatcccagtactttgggaggacaaggcaggcaaatcatctgaggtcaggagtttgaaaccagcctggtcaacatggtgaaaccccatctttactaaaaatacaaaaaaagtagccaggcatggtggcaggcgcttgtaattgcagctacttgggaggctgaggcaggagaattgcttgaacccgggaggtggaggttgcagtgagccgagatcatgccactgcactccagccgggatgacagagcgagacttcgtctcaaaaaaaaaaaaaaaaaaaaaaaaaaaaaagaaaatttgaagttacatctcaaataactttggaaattaactgtatcattttgctatctccaactataataggtatttgagaatgggccttgtatatcagtgcaataggttttaccttgtaaatgcattgtctgtaacaatataaaatgtaagcactaaaaaatttaatacattcagtctgagttaactcttggaatctctcattctttatttataaatttaaaggaaaggtaagctaggcagatttctatagtggccatcgagttctaaatgtctttgatatgtttctctttgcttttatgtgaaactctggagtacttagtgaagaagattcctacttttgccactggaaaggcagctaaaaaataatgataataacatcctatccctattcaaaggagacttaattatgaaattattacactgtattcactgagtatgtcattaaaataccatacagacaaaatgctcagcatctgtatgatacgcctattatctcctgacaaaaaaatgaaataacacataaagacaaatacaagtctttttcctaagcctatacttgataatatccatccctaattatagaatgtgtttcattacttcagtgttagatggtatgtagaggaaggccagatggatcagaaaaattaaatctcattgctttgcaatttttgcaggtgcagttaattcacacagttgctcaaattccgtatttaatatgaatccagaagacaacatacatctcttctttctgatacaatttgtactaaagacaatttaaaatgaggaacaaaatacattaaattggacagacagttttacagaataaaccttcttaattatcatataatatttatttcgaagaaacaaatgacttatgatgccttctaagtatttgacaataattttgctcatgatttcaatgtcagtacttattcaagaaattttattaccttacagtaataaattaattattaatataaattaaattattattaaattattgtaataataaattaattacagtaattaatagtaaattttagttaccaggctactgtcctgaactttggcactcattgtatgctacattcagctatgggaagtcctctatacttcataagataaagcattttacatccttgtgattagtaactcagcttcctttgtgaccatctgatcttttgcccaaggattctcccaaagttcaacatataaatattttcttttgcttagagatgcaaatctttaccagatttttgtgccttgtgctaccatgcctgtggagttggtttttaagcatggctatcaattattatctaaagctgttgctatgattatgcagtatgttttaaactgcagaagtgcaattcctccatgcccattaaaacttattgatcactccaaagggttacatatacatagacagacaacgcaatgaaaagccttgatccacagttgtcaacctgattgtgtgtgtgtagtgtattttgactaattttgcacagatttcaatatagcatgtcaagagccaaacatatttaacattgagtaattcttcctatataatagttatgatgtgccattgtttacaatttcagtattctgaatttatatatgtgtgtgtatgcatacaaatacacaccccttaaaaggaaaccaccattcaaaaaagtgtacaagtgtaggagcaagtgagcatagctgataagagttggatgaatgaacattcagacttggatttatatctatgctttgctactaaaaagttttatctgcctcaacaaggtcactttcatctataaaataggaataatattagtacttactcttagggccattgtgaggtcataatagctaccatttattaaagctttacaacatagcaagggagtttttctagatcttttgaataagataatcaattcaaaacacttattgtaatgcctggatcatgcagaaagcttcataactggtacctgttattgcaagtattagtatttgcaaaataaagattttatgctaaattagtaactaatactttatagcttgaatctttctagtaagtatctaaatattcaaatactagaatatctcaaaaggcaagaagttgaaatctcttatcccagcataacaaaaaagttacaaaggcaataatatgtaaataattaaatggaaagttaaaagtttcaattaagaatatcagtcaaaaataaaaggaaaatttattagcctgttcttacactgctataaagacatacctgaaactgagtgatttatgaagaaaagaagtttgactcgttcgtgtttgtggcattatagtattccttggtgtaaatgtaccacattttctttatcttgtctatcattgatgagcattaaggttgattccatgtctttgctattgtgtatagtgttgcaatgatacacatgcatgtatctttataatagaatgatttatatttgggtatatacccagtaatgggattgctggcttaaatggtttttctgcctctaagtctttgagaaatctccgcattgtcttccacaagggttgaactaatttacactcccaccaagagtgtaaaagtgttcccttttctccacaacctcaccagcatctattgttctttgactttttaatagtaaccattctgactggcgtgagatgttatctcattgtggttttgatgtgcatttctctcatgatcaatgatgttgagttttctttcatatcgttttaggtcacatgtatgtcttcttttgagaagtgtttgtttatgtgctttgcccactttttaatgaggttatttgtttttttcttgtaaatttgtttaagttccttgtagactctggaccattgtcagatggatagatggcaaaacttttctcccattctgtaggctgtttatttactctgacggtagtttattttgctgtgcagaagttctttagtttaattagatcccctttgtcagtttttgcttttgttgcagttgcttttgccattttcctcatgaaacctttgcccatgcctatgtcctgaatcttattacctaggttttcttctaaggtttttattgtttggggttttgcatttaagtctttaatccatcttgagttaatttttgtatagattgtaaggaagaagtccactttcaattttctgcataggactatcccagcactatgtattaaataggcagtcctttccccattgcttgttttttcaggtttgtcgaagatcagatggttgtaggtgcgtggtcttatttctgagttctctattctgtttcattggtctatgtgtctgttcttgtaccagtaccctgcttttctggtgactgtaaccttgtagtatagtttgaagtcttagcttttgggctgagacaatgggggttttctggatataggttcatgtcatctgaatacaaaaataatttgacttcctctcttcctatgtgaataccctttatttctttctcttccctgattgccctggtcagaacttccaatactatgttgaaaaggagtggtgagagatggcatccttatcttgggccagttttcagggggaatgcttctagcttttgcccatttggatgtgggtttataatttatggctcttattattttgaggtatgttccttcgatacctagtttattgagaatttttaacatgaagggatgttgaattttattaaataccttttggttgtctattgagatagtcatgtggtttttgtctttagttctgtttatgtgatgaatcacatgtattgatttgcatgtgttaaactaaccttgcatgctagggatgaagcaaacttgattgtggtggataagctttttgatatgctactggatttggtttgctggtattgagaattgttgcatcagtgttcatcaatgatattagcctgaagtttgcttttctttctttctctctttctttctctctctctctctctctttctttctctctccctctctctctctttctttctttctttctttctttctttctttctttctttctttctttctttctttctttcttctttccttctctctctctctctctctctctctctctctctctctctccctccccctccctccctccctccctccctcccaggttttggcatcagggtgatgctgacctcataatataagtttgggagaaatcccttcttttcaatttttttggaatagtttcagtggaaatgataccagctcttctttgtaccgctagtagaattcagctatgattccatctggacctgggcttttgttggttggtgggatatttattattgcctcaatttcagaacgcattattgatctattcagcaattcatttcctttatggttcagtcttagaggggagaaatgtgttcaataatttatccatttcctctaggttttctagtttatgtgcatagaggtgtttatagtattccctgatggttgtttgtatttctgtagaattattggtgatattcctcttcaaatttttcattgtgtttatttgattcttctctcttttcttccttattagtctaactagaagtctaccttttttatttttatttttttccaaaaaccagctcctggattcatttagttttttggagggtttttcatgtctttatctccttcagttcagctctgatcttggttatttcttgtttgtttgctcttggtttgctagtttttttatttgagatgttaggctgttaagatctttctagctatttgatgtgagcatttagtgctataaatttccctcttaacactgctttagctgcgtcccagagattctgataaattgtctctttgttctcattagtttcaaagaactgcagaggtggcagctggtcttcctcccagaagctctgtcccagggagagatcagagctctatccattgaatcctgggtggaatggctgaagccccctcagggaggtcccacccagtgaggaggatggatcagggtcccacttaaagaagcagactggccacgatctggcaagggttgccacacactttcaaacaaacaaatctcatgagaactcttatcaggagagcagcaagggggaggtccacacccatgattcagtcccctcccaccaggcccttcctccaacactgaagacagaattcaacatgaggatttgggtggggacagagagccaaaccatatcataaaataacagcataaacaaaatgaatttaaaattaaagaatagctgaatagttcgtaattgcaactacagtcatatgctgcataacaacatttcagtcaacaatgaaccacatatatgacagtggtctcataatattattatactatattattttttacttttatttttgcttcagaggtacatgtggtggtttgtcatatagataaattgcatgtcacaggggtttgttgtacagattatttcatcacccaggtaataagcatagtacccaataagtagtttttttaatcctcaccctcctcttaccctccagcctcacatagaccaccgtgtctgttgtccccttctttgagtccgtgtgttctcaatgtttatctcccacttagaagtgagaaaatgtgatattttgtgttattgtgttagtttgcttaggataatggcctccagctccatccatgtttgctgcaaagaacacaatctcttttttcatggctgcatagaattccacagtgtatatgtaccacattttccttatccagtctaccactgatgggcatttaggctgattccatgtgtttgctattgtgaataatgcttcaataaaacatacatgtgcatgtgtctttagggttgagggatttatattcttcttggtatacccaataattgttattgctgggtcgaatggtaattctggttttcgttgtttgggaaatcaccaaactgctttccacggtggctgaactaatttacactaatatcagcagtgcaataaacgttcccttttctgtgcaaccttgccagcatctgtgattttttgacttcttaataatagccattctcactggtgtcaaatggtatcttattgtggttttgatctgcacttctctaatgattattgatgttcagcattttttcatatgaatgttttctgtatgtatgtctttttctggaaagggttcatgtcctttgcccactttttaatggtgatgtttggtttttgcttgtaaatttaagttccttgtagattccagatattagacccttgtcagatggaaagtttgcaaaatttttctcccattctgcaggttgtctgtttactctgttgatagtttcttttgttgtgtagaagttctttagtttaattaggtcccagttttcaatttttgtttttgtttcaattgtttttggtgtctttgttatgaagtctttgcagtttcaatgtccagagtggcattacctgggttatcttcttaggtttttatagttgttggttttagatttaagtctttaatccacctcgggttaatttttgtatatggtgtaaggaaggggtccaatgaataggcagtccttttcccattgcttgtttttgttgatttcattgaagaacagatggttgtaggtgtgcagccttatttctcgactctctattcttttccattggtttatgtgtctgttttttgtaccatgctgttttggttactatatccttgtagtatagtttgcagtcaggcaatgggatggttccagcttttttctttttgcttaggattaccttggctattctggctcttttagtggctccaactgaatttttaaatagtctttttcttattcagtgaagaatgttattggtagttttttgggaatagcattgaattaaaaagtgctttaggcattatggccattctgtcaatattgattcttccatgagcatagaatatttttccattttttgtgtgttatctctgagttacttgagcaatattttgtaattctcagtttagcagtgtttcacctccttgcttagctgtattcctaggtatcttatttctttttgacaattatgaatgggactgtgttcttcatttggccttagcttaaatgttgttggtgtgtaggaacactagtgatatttatacattgattttggatgctgaaactttgctgaggttgtgtatcagatcaatgagcttttgggcagagactatggccaaagtatagaacctcatcgtctgcaaacagggataatttgacttcctctcttcctatttggattgcctttatttctctttcctgattgctttggctaggatttctagtactatgttcaatgagatttgtaagagagggcccccttgtcttatgccagttttcaagcacaatgcttctggcttttgcacattcagtataatgttggctgtggactttttaaagatggttctaattactttgaaatatgttccttcagtgcctagtttgtcgaggatttttaacatgaaagggtgttgaattttataggatgccttttctatatctactgaaatgatcatgtggtttttgattttttgttctgtttatgtggtgaatcacatttattgacttgtgtatgttgaatcaacctcgcaaccctgggatagaagctccttgatcatggtggattagctttttgatgtgctgctggattgggtttgctggtattctgttgactatttttgcatctatgttcattagggacattggcctgaagttttcttttttggttgttgtgtgtctgccaggttttggtatcaggacaatgcttccctcatagaatgagttaggaaggagccgctcctcaatttttgggagtggtttcataggaatgataccagcttttccttctatatctgttagtattcaggtgtgaatctgtctggtcctgggctttttctggttggtgggctttttgttcctaatttaatttcggaactcattattggtctgttcaatgattccatttcttcctggttcaaacttggaaagttgtaagtttctagcaatttatccattgcttctaggttttctagcttgtgtgcataggggtgttcattatgaatagtctctaagggttttctctatttctgtggggtcaatggtaacatcccctttgtcattttttattgtgtttatttgagtcttctctctttttttctttattattctaggtagtggtctatctttattattaattatttcaaagaaacagctcctagattcattgaccttttctgtgcttttttgcatctcattttccttcagttcagctccgattttggttatttcctgtcttctagctttggggttagtttgctattgtttctcgttccttgtgatgttcgttttgtaattagagatccttctaactttttgatatgggtgtttcgtgccataagcttgcctcttaacgctgctttgtgtgtgtcccagagattctggtatgttacatctttttaaattttcattagtttcaaataatttcttgatttctgccttaattttattgtttacccagaggtcattcaggagcagtttgtttgatttccattttaatgtatggttttgagcaatttgcttaacattgatttctatttttattgcactgtggtccaagagtgttgttggtataattttgtgggttttaaaaaaattttctaaagattgttttatgcccaactctctatatcatatttttattgtacctttcgatatgtttggatacacaaatacttaccattgtgcctacactattcagtatagtcacatgctgtacaggtttgtagctaggagcaataagctgtaccacataggttggccgtatagtagtctgtaccatctaggtttgtgtaagtacactccacggcgttcgtacaaggacaaaattgtctaaggatgaatttctcagaatgtgtcccagttgttaagttatacatgacttgtagtgattcctaataaactggagacagtggtagaaaaaaagtattttattttattgtatgtccttttgtattctttaaatttgctttgatgtacttatgtttctttttttaaatgtgcattttttaaacaagtggaagagaagatggaaagaaagaacttcatttcttgagcatagtttgtttttcccaggcctatcaaaataacacaatcttactgcaagaagaggcacaccctggaataatatcaggatgctggcaaatgctcttccaatttttctcagaatgagaaaatgtaaattttaaagtttaaatctttttaacatatgtaatcttatgagtaagaaggttgagtatagaaaaattcttcaaatttccctgagcgtttagaaaagatagtggttactgctgatatttaccattatagagcacttattttattcagatattatatcatttaattctcaaaaccaggactggctacataatttgtgggcccagtgcaaactgaaaacaagggcttcctgttcaagacctaagaatttcaagacagtggaagcagagcttgaaaacaagcatggaagcctcctgagcaggggccctgggcaactgcataaattaccagcccatgaagctgtccttgcttgtaacacacctgtgaagaaatgtgttactcttactttaaagatgaagaaaataatgcatagatttgagataagaaccaaccagccccaaatgtcacagtgtataaactatggatctggtgtttaataattgtggagactggctccaatgcctctacttataaccactctaagaggaatcagctcccaaatgtaaagacaagtatttctaaactatttcccatttttactagggaaattaacttgcagttaaaatgaatagtattttaaaaagaaatgtattttcttttcatgatatcattttagagtcttaaatagactcataatcaaaatgaagaaaggtgactgggtaaaagtatagttagctagatacaaagattgttgaatataggtcaaactatattctattctagttttgactctgccatattaaacattttagtgaaggcactacgttattcttatcatgcttgaagttttcctcattctaatgcattgagtgacaggagtatgattccatagatcttaatatataaatagaaatgatagatttaaaacaaacagtttggcaaaactttcaaaatttttctttgcttacaaatgcaacattttgcagataatatcttatagaagaactttggaaactaaaggaatacagaaatatacactgtgcaacagaaattttctctactttctctgtcaaaaatcaaccaatgtttatgtctagcattgtttactcaatagtgtaaagcaaacgttttccaatgacattaaaatatttgaaatataatactccatccacattcatataccataatgtacttaaaccatcatctatgacatgaggttgtttccaaaagttactgttagaaagaccctataaacaaggataaatattatatctagccttcagcatcaaattaaatctaaatgttaaaatgctagctgagagaaatctgttttcataacatttaaagagaaaattacttgattactgtatgtttggtgtatgtaattattttgcatactggtatttttcacgtggcattcatcttcacaattatttgtgtgattatcatcgtccctattttgccgtaaggttcctaaatatggagtttctattttactcatttctgaatgtcctatagtgaatatatattcaataaacattagaattttatagaaaccttgtggttcagctgctgaataacttacacagttttagaattctttgattgactatggtgtccaaagccaagaaacattggttttggatgacgaatcaagttatatctacttctagcaaataactggcattatagagtttgaaaatgatatttatcagggtcatgattattagatttcaaatcttagaatatcaggtagaaatgatattcaatttactctgctttcattcagaactcaaaacaagttttaacaagaggaagtcttaatcaggcaggattcctctggttgttaagaacatctttcccaatggggaaagtttgcttgcatgctaagaaaggagctttctgtttcagggagtagtgagctctgtaataatcaggaggtcatgttaaatggccttcgtagtccctctcctgtctatatttcctaatgattctaacacataattaagtgtcaataatagttatagtcaataactataagccataaggaaatttagtacatgactgattgttttttattctgattgtatgaagtaggttttgagagtgattattaatttgttatatgtaatgagttctaccctatatttacagggtgaatgcacagttttcttatttctccatcccgaaggaaatgaagtagtatttttcaattacagtgtagtagtgattattatatagaacaattacagactcatgtcttactactcttttattaaaaatgattcatttttctttcttaaaaggttgagtatatttttaaatgccgcttcacagtatatcatgttgtcatttccctttaccctccatgggcacatgtatccaattttataagtagataccacgaaaatattaatattacagaaattaatttaagagtcaaatttttagtagcacaaatgttctatgagattggatataactgcatgaattagcttggtattttcagaatctctgcattctggtctgtatgtttaaaattaggtattttcttaatctgcaaaatattatcttctagcctccactgtatgcaaagaaagtgtgctcatggttaaaaaaatattcaaataaaaaaataaattatcttgggatcctactaaaaactgcattttctttgcaaagcaagttttctcatggttaaaaaatattcaaattacaaagtaaatgctcttggaatcctactaaaaactacattttctttttgactagaaataaaactaattttatcacgtaatggtcattttgtgttgggtgcaatgtttgagtttatattttaagctttttttagagctatgttgctttctgctttcatcttgacataacttgtcaacagacttataattaaagttgtttgaggttcagtgattcattctaaataatgaatctatggagatcctagagaagataaaacctgtgcttggcaaatgtagaaactgtaattcttagtatccttttagcctaccaaaatggaaatccttcagtccctcacataggtaaagatatgtctttaacaaaaggtagcctttttaagctatgtatgtcaaagcaatttttacttaagacatcatggaaaagattttattccttcactgttcattgccaatttggaagctgaaataagaagatcctgaggcttttcccatttcctcacatgaaaggaatcagtcctcgtgtatgaggcagggagattactacaaacccttcccttacctcttggcaaattcaggaaaattgctaaaatgaatcttgacccagccagatccctgctcctttgcttgtaaccagaggcagtttcaatgcaggcctcttgtgacttccttggaaacagaccttgcatataagttggattgccagaaggataatgattaccatcccaagaggtaacgttacaatcgtcatgagaggagctctgtgagacggagaatatgataaggaatgattgtctcaccattatatgacttgtctatctcgtaatgcccatgtattgaggtgatggcctctcatgtcttggctcacaaaatgtattattccaaagatggatgaactgttgcccccggcccgctgccaaaagtatgaacaggaggtaattgagattctaaaccaagaagtgtctccagtgatgaatatgggaactcaaatatttgaacataatcactaatttaaatcaaacaagagtagtgtgttttttagcatttgaataacattcaacataaagatatatatggactaatacatactttatgttaaccttttattgtaattttaaaagctgtttcacttatttgattaaagagtcgttcattaccaagttgaaataattttatttaaaaatgtataacataaaataatcaatgtgtatgataaccaaaaatgcattctacaaactattaataagcatttaaaatgttctaggcaatggaattggtactgatgtacgttagtaacattcatattaatgtaaacattttaaacagcatgtagaattaactatcagaatgaattatactctacatttttctcctctgcccccaccccttatttcctacagtttgaccaatatattgaaggggcgctaaattgactttcgatgttgagattactttcccttgctatttcagtgaaccaaacttaagtcagataaaacaattttatttggcttcaatatggtgctattttgatctgaaggtcaatctaccaacaagcaagaacagtttctcattattttcctttgccactccaagcagtctttactgaagtctttctagcaatgtctgacctctgtttcaatacttctcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggtgagagcatcttaagcttttatctgcaaatgaagtggagaaaactcatttacagcagttttgttggtggtgttttcacttcagcaatatttccagaatcctcgggtacctgtaatgtcagttaatgtagtgagaaaaattatgaagtacattttaaaactttcacaagaaatcactatcgcaacagaaagtaaatgcttaatggaaatggtgttttctggggtgaaagaagaaactatagaaactataggtgataaactactgtggtagcattttaatcctaaaagtttctttctttcttttttttttttcttccttataaagggcctgcttgttgagtccctagttttgcattaaatgtcttttttttccagtaacggaaagtgcattttcatgaagaagtacacctataatagatgggatccatcctggtagtttacgagaacatgatgtctcagtctgcgcatcctaaatcaggagtaattacagaacacatttcctgttctttgatatttataaagtcttatcttgaaggtgttagaatttttaactgatctttttgtgactattcagaattatgcattttagataagttaggtattatgtaaatcagtggatatattaaaatgatggcaataaaattttatgagtgcaaagctggcataaaaattattttaaaaggtacaatttccctttcattccagttattgtaattctaagattaagaaagaacgttaaaatctgccgtatgtttttaagcagcatatgtttagaaactcatggaacacttgacattagaatttgtgtataccagggtagagaagtttgaaaagaacacacatctaaaaataccatgtcagatgttctaagaaaaaaaataaatctagagaagttattcaaatatattatttgggatgtttagtacttctctattaactaatgacttatgacctactttgataattccaaagtaaatcactgggccttttctccctggttgtgtcagcttggctaagcaaatccactagtccaggggtcaccaaactaagacctgctaaccaaatttagcatgctgccagtttggtatggctcatcagccaagaagtgtttttacgttttcaaatggttgaaaataatcaaaagaaaaataatattttatgacatgtcaaaattacataaaattcaaatttcagtgttataaataatgttttagtggaacacagccaaactcatttatttatcacttatgattactttcgcattacaacggcagagtttgaatagttgtaacacaaactgtatagtccacaaagcctaaaatatttattacctatcctatcacagaaaaagtttggcgacccttgctccagtcaaatggctctcaaactctatgaatattagcattctttttgtggcaacaactttcaggaacttccaagcactctactcacgatggtaatagaaaatctaacaaaaattgatggagtgaaaagcataatggcacaaatccgtgaagcttttgatgaatttcttttattattcctagtaagatgtacattaacttgtttgttgtcacattaaacatgtgtttatagacaacgcttagtggacatacagatttatggatactttgcaacattccaacaaccctccaacagttctccaaacagagtaatagggacacctagttgcctaacacttttaatgtcttcaggacttgcctaatacagaaattaacagagcaagctgattcatgtcaatctctgtcttcaaaagcttattattggctcctgtttggagaatggattgtgttggaaaaaaaaaaaaagtgtgttctgacttctttttgttttcaggaaagagtggctagtggtgaaataccttctctccaaaatttgtttgtatcataagttttcggcaatttttgtatgtgcctaaatgagaagtcccattgggcacatacagaaagattcttcaaataaaagctaacataaattgaggatttattatgtgctcagtagtagattcagtgctttattggcatcgcatgtatttttcccagtaacctcccaaaataggtatggctataattactttataaaattatacacagctacagtgtacctcagacaggatttgaactgaggtagctacaaaacctgggctgtatagtaaaatgtctttttcatagatatatgactaaggtaatcctattgatttacctgaagccatcccagttacacctgttgtcccagcataattatatatagcatcaactttcactctcaagtgtgtcctgatttggacggcaaaattatctgaacacgctatatacgacacttgattgataaatttagactgaacgaagatagcaaaaaggcaaacatttaggaacaaattcattaattgataattgtctacagggtggaatcttgttaaagtattgtaatgattaaagaggcatcatgcaaatataaccataagctttatattagctagtgccccgtttttgtatcatctgaagcccactaatatttcactgaatattgaggtcttgaccatctgttgaatagtgttttatttaaatgatgtcctcttccagcttctgtgacacactaccagttgtcacccacgactctttacctgacttgttttattccttctgccttattcctatgggagtatcacacagatccatctctttgcctttctgacttcttttattttgagacagtgtcttgctctgtcacccaggctggagtgcagtggcgggatctcagcttactgcaacctccgcctcctggtttcaagcaattctctgcctcaacctcccgagtagctggaattacaggcaccctccaccacatccggctaattttttttgtattttttagtagagacagggtttcaccatcttggccaggctggtcttgagctcctgacctcgtgatccacccacttcagcctcccaaagtgctgggattacaggcatgagccaccatgcccggccttttgacttctttatctggattatctcctctcattgattcgagcctggctctaagtgactgactcccaaatcatgtagctccagatgtgacactctccctcaaattaaagctttatatctctaaagctatttccgcttgtgcatccagcaactgcctcaatgttcatcaaatgcaaacatttgttccttccaattaaccatacctacttatacattgcacacatattttagttataattcattgcctgtgtgtctagagaagtagcaaatatggaaaaaatcattgcttttggaatcagaattactgaggtttgaatgctgccctttttttttttcccaacttttagtttaggttcaaggggttaacgtgtaggtttgttacatgggtaaattgcgtgttgtggctgtttggtgtacagataattttgtctctcaggtaatcagcataatatctgataggtagttttcccatcctcacctgcctcccaccttccactctcaaataggccccagtgtctattattcccttctttgtgtccatgtgtactcagtgtttatctctcacttataggtaagaacctgtggtatttgtgaaacctgcctgttttaattactagcttatgagcgcaggcaaattacttgttatctgtgcctcagattccagtattctcactttataaaacaactgtcatgaggattaaataagcatttaatacattgcctttaaggtggtaaacattcaataaatgcagtggttcgattcttatttggtggtggagaccatagagatgatgaagatggaggaagattgtggtgggtaggaggagtagaagtgatggtgggagaggtaacgatagtagagatgatgatgatggtggtggaggtagtgatggagatggtagtcatctattatcgacagggaaaaattccataataaacattatctcaaacctaagaaatgtaaaattaccttcctgttttcctcttcaaaacagaatttaccacctgacatctctagttctgtgaatttttcttctactttcttttccttatttattataattagattgtattattgggcaagtgccatcatttccgtcatttcatgttcattcgaattgccaagtccataacctgagccatatacctcactgtggagagaactgccctcctttctaattgatttactaaaatgaatatatctaaaatgatgctttttgatgtctctccagacatgcgaattcccataaatccagatacctccaaaataaaacccaagtgcttcctatggcattcagtattattctcattctccactaattttatgtctaccttcccaataatcattattccacttcagccagtaaattacattacattcgttttgttgtatgccttcatgccactcacataaaatttctcattgcccgtcaaaacaaaggaagcctattattacacttctttatgttttacttagattccattgtagcaaataccgtggatacaataagtaaccaataaatgtttgttgagagagtgaatggtatataattcaaataattgcagtaactaaaatttgacatttcaatatcatttaaaaattctacctagctcttcctggaattgttcttaataataaacgtgaccatcctgatgatctttaataattccaattttacccattagggtatccttatttacccaaaacaattaagggatttaaaattcagctttctaccacatagtttcttaactatctaaggtacatttagtcgattcctaaataattatacagtttctacatatgttgtatttattgcataaatttttctctttacactgagatttgcaaaagtgtctgatgatcttgggtcacaagataattatttctaatagcaaattattcctgcaattcagtgatattattgtacacgtaggtaattatcagagtaaggaactcagcctagggtaaaactagatctattatctagttaattggtatttatccaggagattacttcctaatcatgtagcagttattttaagggatttttaaaaaaagctttaatttatacttttgtagcaaccaggcagaatgaatggcaaattgtttttaagtgaatgccatcttaataaagataatttcccccaagtaaagcgttcataaatgaatatctttgtcctcaaggataatgtagaggcattttgaaatgcctcagttcacctggtctgttttttccctccagggtaagcagacagaatgtaagcttgctttctcggctatttcctgcatcctaactacataggaggataaattgactgatctacatacctgaattattattatatattctacttttcagtttgtttctgttttttgtttgtttgattttctttttatggctgctgtccagatgaagttaaattgtgtcacatctctggaaagaaaatagataacagataagaccgctctgcagttttgtgagactcatgcctaaaacatttttgttttagatattgattataacttcagtttctaaactaaaatctgaaagttgtatggcaaaatataccaagttatttgaaggacctaattagataattaatgtgtccgtgaactttttttttttaatgttctatatgataaattgatcctaaaatatctgggatgttaaactcagtaatgacacttttgcctattggcacagcccatagaaacaaaacattttagatgatttgcttctttttttcctaaggagactagacttatgcatgtttacaggttaattgaggtccagaaaggttaaataacttgctttcagttgcaaaataaggactggtgctgactctcctaaatccattctagtgttatagttgcaatgtcatgttactttttatgtattaaaggaaaatgaccttggtcataaattcaaatttcgctttagacactattttttgttaaaaaaaaaaaaaaaagaaatagaaatcttgcataccatcttcacatcctcaaaaagataaccatctattaaatgttcttgagattatgttgtcttatgcatcaagaataaatcaatagcagtgttttgaagaatatagtaatgtgaattctagagaatgctatgggatcagagaatacttagaacagtaatattcaaactgcagtgcatgaaacagtatcatcacctgggaccttctttgaaatgcagatttggagggcccttcccaaacctgctgaatcagaaacactgctggtgggcccaaaaatattttacaagcactctcggtgatacttatacaccataaaatttgagaaccctcgcactggcatgacaacagtggttctcatgcttcagcatgcgtcggagtcaccagagtttctaattctaataggcgtggagtggtgcccaagaattttaatttctaacaaggtcccacgtgattctgctgctactgatttagggcccacactttggaaatcagttcactggagtgtcttgtcatttacagtctgacccctgattctctttccttatgacagcccccataaaggggctttcacgtatgtccgtgtgaagagaccaccaaacaggctttgtgtgagcaacaaggctgtctatttcacctgggtgcaggcaggctgagtctgaaaagagagtcacggaagggagataggggtggggccgttttataggatttgggtgggtagtggaaaattacagtcaaaggggatttttctcttgtgggcaggggcgggggtcacaaggtgctcagtgggggaggttttgagccaggagaaggaatttcacaaggttaatcgctcggttaaggtggggcaaaaacaaatcacaatggtggaatgtcatcagttaaggcagcaaccgggcattttcacttcttttgtgattcttcagttgcttcaggccatctggacgtaaaggtgcaggtcataggggaaaggatggcttagcttgggctcagaggcctgacaggggccatctattcctgggcaggttaagggatgctactgttgcatcttgtgacaccttactgctttatgatgaaatgatctatccatatgcttgtttcatccactagaattaaagcttccctgggccaggatccatttcttgttcgttacctgtgtgatgtcttctgtgtagtagatgctcaattcaagctgtgaatagaaatgcactatattgagaactggtcctatgagatactatatctttggatgtctggctacagtagctatgtgaaaatgtattcttccagaatgcaaggcgtaaaagaatatcaacacgaaagaagacaggatcacattcccagagctgttacatataattttgttcgttttttgagtgaagaaaatggtactcatacttattcatctaaaaggagaagcatagttgagtgcaaataaaagtcagtttttaatcagaagacctgaactatctgtattcccttacggactcctgattctttcctttaccctctcatactctacatcgagcactgaaactgctctcagcaaggtcgccagagagctccttaattgccagctccaaaggtcactcttcagttcttttccctttttgacctttgtcttgtgcttgacagaaatgattagtcccttcttgaaatttttctctcctgcagtttctgggacattgttctctcctgttttctttcagagtatatcttccctgtcttctattcctgccctttaatgtcagtctacataagactcaaattgtgattttattttcttcttatgatgctttattttttggggaaatatcatttataatctttatcatcacctatatttttgattcacaaattgatatttctacctctccctctctcctgatgttcatccctgtataattcaaatgcttataggctatgtattcctggatttctgactggaatctaaaatatagttttggagtttagatcgtataactctagagagggtcattcacatcatagtctctaagaatggtacatcctgaacttgtgcagtgagcaacctgtgcagccattcacagtggtcttgatatctgccacatcactaaatccctccaaatgtacctgttaaattctctttagtttgttatttttttctacatccttgctgccttcactctagttaaaactgaaatttttctgtatgaaatttttaactgatttctctgcctctgatctcacctctcttatccatgctttttacagcctcccgagggatatcttaaaatgcagttttaattagattattcccctgcccataaatcttgaaatgcatggcgtagaaattcttttgtgatctttagctgcctacctctccagcttcactcccttctcctctgctccttttttaaaaaaaataccagtgctactccaaataatctgcaaactttttagtaccagtccacaattgagataagaagcttgagccagaatataaatcaatgtactccttcctttgtcaagaaagttcggcaattaaaagcaaaataagatcaaatcgtttgttcagtgactcagttgatttatactctggtgaaaactcttttcttcttacagactaatagcaaacagttcactgtctgctaaagtctgaactttgttccgcactgccctatgctttagcttaaattaaccactctttgatctccaaatgctctgtgctttcttaagcttctgtttctttgtacctactgttttctctgcctaagattctctttagatacctttctttttcccattcccatgttacctgccaccgtgctactaaccaccttgtctttctggttatctaaccttgcagaggcagttctcagccatttgtgtgttttttttttttttttttttttttggagacggagtctcactctgttgccagtctggagtgcagtggcgcgatctcagcttactgcatcctctgccccgtgggttcaagcgattgtcctgcctcagcctcccaagtagctggcactacaggcaagggccaccatgcccagctaatttttgtatttttagtagagatggggtttcaccgtgttggctaggatgggcttgatctgttgacctcatgatccgactgctaaggcctcccaaagtactgggattagaggcatgagccacagtgccaggccacttctcagcctttttaacacttctattaaaacacttgccaaattgtatggtaatgactttatttttgcatgcctgtatctccagtaaacgccttgagggaagaaatcatttcttgtcatctgtacacctataatgcataaagcagaagtcagctcatagtaggtattgaataaatatttattggatgttgatgagggattttccaggttttgtgcgagtcttgtcagaaaaacaaaatcactgtgatttaaagagaggaaacgtaatataaggaattggctaagcaggtagtagaaaactgagacgcagcgcaggggatggagaggcaactcaaagcactagtaacgtaaggaagctgctaatatccctagagctggagaaacaatacagaaaaagtgatattaccagagctcagaagctggggctttctaacagagattaaactaaagttaggactgccaggcagaaaattggattgttgaagagggagctagctatccagagaaaacagaagccacagcagagatacatctgctctagaaatgccacccaaggtagttggagaagaaaaaagaccttggcttttctcttcctcccaccttccaatattctgccattgcctccaaatgaacaattaggagggcaagtggtgttgggaaatgtatatccctctaatacagaaagtacagaagaaatgtggggaatagatctgagagcagatgggcatattactgcacagatgggttctggccgtgcatcttctgctcataaactatgtgacttaagccacttaatctccccaagaatctatttcgtcacccctgaaatggaatgtatatggccttccctgtttgccctcacactgtggaaattatattacatgtgtttgtcttgaagaacgtttacatttaaaaaacaatgtctcctttccccaggagaaagttgagtttccaattattaattcagggatggtatcttcccatgaccacatttatatattattcttattctgacatcttctgagagtattcttagtaaagtcttccctggtcagaaacctgtctctttacaaatgaacacatattatgctaccacagagatataaaaatgatgccaggctgggatggcctgaattgtgtcctccctaaattcttatattgaagctctaatctccaatgtgatggaatttggaaatggagactttggaagataatttgatttagatgaggtcatgaagatagggctcttctgaggagattagggcccttataagaagacacaacaaagagcttgctggctctttctccctgccttgggaggacacagcaagaaggaggttgtcttaggctgttcttgcactgttataaagaaatacctgcaactgagtgacttacatgaaaattgatttaactggctcacggttctgcaagctgtagaggaagcatggtggcgtctgcttctggggaggtctcaggaagctttcaatcatgatggaaggcaaaggggaaacagtcacatcacatggaagaatgggacaaggagagtgagacagtgcagggggaggtggcacacatttgtaagtgagttctctcaggagaactcactatcgcaaagacagcactaagccgtgagggatccgctcccatgatccaaacacctgccaccaggccccatttccagcactggagtttacaattcagcataagatttgggaagggacgaatatccaaactataccagaggctgtctacaagccaggaagaaggctgtcaccaggaactgatcctgctggtaccttaattttggaattgtagcctatagaactgcgagaaataagtggctgttggttaagccacccagtctatggtattttgttatgtaagtgctagctgactaaaaaccggctttgttaagcaatgagtattacttctgttttgactaaagttcatagtgatgcttactaacacagtagatggattgaaacaggtcatgatgctggcagtggggcattaagtacacgtcagattgaaatggctttccacattgcactagatccttttggaacccgggttggaagttatttaaacttgaaagacccacaagcatgttgacttctcttaaactcaaggacctttcacactgagagagtttaaagtttaaattgcctcccacagggtccaagtcatcatccaatgcatggtgggtttctttgaacacttctgtagtcattatgagtccacatcatttcaagaaagaagagacagcaacattagttttcatgctaattttcctattcactcaactaatatctaatggattgctatggtatgtaaaacactccagttactttaactgtaaatctaagctttccctcaggaagcttgcacccagcataaactgtcatgaagaagtactaataaaatgttagaaaagttttaaggaagaaaagttcacttcctgcttgagaggcatggaagacttatgggaaaattagcatctgactggataattaaagagtagggaagcattgggctcaagatgaggaaagtgacaattcattgcaggggaaagcctgtatgcgaacaaaacttacatgggattaagtattcttgtttgcctccagcagaagtatgaagtaaaggaagtttagaagtaaggaatgaggttgaaaaggtaggttgagttcataataactaaaggtattcaataaaagattaaggcatgtagacttaaaccttctggtcatggggagccattgcatatttttgagagagagaaatatgatatggctactgtgaaccatatcattttgatctcacttgagagttgggagagagaggccatcttaccttggtttcatagactgggaagggggaaagaaaagttttctctaaagggccagagagtaaatattttaggttttgtgtatcataaaatttattttaaaactactcaactctgctgctatagctagaaagcagccataaacaatgtataaatgaatgagcatgactgagttccagtaaaattttatttaccaaattagatggcagaccatatttgtcccatagaacatactttggggattccggcactaatgggtaaaatgagactattttgctgttgatttttgtttatatgtttcattgtctttgttatagctgtgtttgcagtttttattcttgttattccaattgtggcttttactttatcagtcattaagaagacactaaaacaaatatgactactctcacacgtgagaaagtgagaaatggcatagggcttaaagccagttaaaaaaggatcatggaagatattaataacaatagctaatatgtatatggcttctaccaagtatttgctacatattaatgtatttcacacttaaaatagcattacgaagtaagttttattattgtcactctttgccaatgataacaatgtgtcatagaaatttcaagtgacttgctcatggtcacatagtttacaggaagcatcgcagctaggatttgaacccagacagcctagcttagggtgttgccttcggaaattcctcgccttgctatgttgtaataagttaaaggtgatttcatcaaattatttagctgaaataaaatgcttgactgggactccttaagaatttgccaaagtctatggaagctgcacttattctagattatgtctgttctacattctgaagtatcattgactctagtgtcccatggcaacacttgattatctttaaatacagagacctttttcactgaaaagatttctttaaaatttagatgtctttttcagcatcaaaaataagtggaatttccatataattgaacttttttttccaagtgcaagacttttggagctcaccatggtcttaaccacattatataataagtagtaacttttttcatctatgcttaatattttctctgatgtgagaaattgtatcatcagattagaaagttgaggattttaggaaattaagggaaattccaaggtaataataaattgggaaataaattattttatattgccattagggtacaaagtatacaactaaggatcatattttaatgaaaaatttcagaattaatatcctgatattagagacttcaatcaaattctcatataatccaagatagcgtagtcaaaaccactaaattactgtactgtgtagcaatgaacagtaattctatattgacttatccttattttttttttaagatgggtttctcgtttatttggaacaaaagaaaaatgtagtgttgtagaaatctttggattcagacagacctgttcttgagtcttgactcagtgcttcactgtgtattgaaactaaatgaagatcttcaacttttctattcatgatcaatctgcaaaaataaaagctattacagataacatacaaggtttcttgagcgattaagttttctttttgaaagcctgtgacctgattaagatgcttaaaatgatatatatgtctcttttctgttctttaaatttgaatgaaagtttggcattttaaaaaactttaggtgatttaggagtataattttaagcagatttttagagtacgagtgtccacatatttaactaaacattcaaaaattagttaaaatcaatgaacttgggaaggaaaactacttgctacataatccagaaaattttactaaattatttgaactaagcatgactctccaaactgtggacatattttctcaagggattctatgtattatggcttcaaggtacttttgtgtgtacctcaaaatggctgaaggcattttaacagtgcatctgagagtgtcttacttacatattatttgtacactattttatctatatctttggacattttatatttctgtgtaagtaaaacttccatgaaaatttcatttgtcaccatattttcgttatgcagataagaaaacgaaagaagccaaattgaagacaagctctgaaagggaatgtgcgccctctagtgacccacatttatttatcataaggacataggcagcttttgggtttcatcattttaaataaactttacatttgattttaaaatatatgactcaggattttcaacttgagtatattatattgtatgatcatagatttattactctgacaggatttcatctatcatttaagagaatatttctattaacctgtgttaaggtgattttcttgcacagaagtgtgtttcaaagggactttcaatttattgaaaatgaaaaataggctttaggcatctgtggcttagcagcattttatttcccatcctctgggtcatgcagtttttgcccacgtgttttcacactccttggctttataactaattcctctaatgtagcagtatctgacattttagaatttgtgggggtttcttaccttttaatttttaaggttgtttctctcaaagatatttaaacaaaacttataaatgtgacatctgttcaatcatgtcacactttagaaataaatattaccaatgaattttgaaatgattaagatttaataccaaattaaggtaggaagattattttaacatcatttctacctaccagacgtcaaaatattttaggtaagttttactttgtgcagagaagcaatattttacagcagttttattctcttcactgcaatcaacgattctatgggtgccaagatgaatatcaataccaaataactcagacatttttggcattaatagcttaaaacattaaatcattcaatttgtatgcaagggcatgtattttaaaaagcagaatttttaaacatactaagtatataattcggtatgccataattgataataaagaagatgtacaattttaaggacaatattttgtgcttggactagaattcagcttttgaggcacatgttaaataggcatattttaggacaaggtaaacgccacagaaattgattttttagtatcttttaaagatgcctttcagtgcaatctgaaatcattaaattttactgtactgaaacatattattttatgagtgatgtgcttaaaattacacatataaaactagaaatacatttgagaccatgcaaatataaggaaaaatagatttttgataggaatgttaatatagcagtttccactaactgaagacagagtcctctgtcatctgtcacattgttccaggtgctgtgtaaaccactgaagagtttataggctttttattataactgggaattataacatctttagattttatttaatttgattgctagatgaatagactaatgtaattggaatatgaaagccacaatataagcaaagctgatctcagtttttgtatcttgggtcaaaacctctttaattagagaggtaagtaaacatatttacaagtaatttttaaaaagcatttgtattgtagacccagaaaatctgagacaggtctcagttaatttagaaagttgattttgcctaatcctaggtactcgggaggctgaggcacgagaattgcttgtccccaggaggcgggggttgcagtgagattgtgccactgcactccagcctgggtgatagaatgagactttgtctcaaaaaaaaaaaaaaaaaaaaaaaaaaaaaaaaaaaaagttgatttttgccaaggtggaattcgcgcgcctgtgacacagcctcaggaagtcctgacgacatgtgcccaaggtggttggggtgcagcttggttttacacattttagggaggcatgagacatcaatcaagtacatttaagaaatacattggtttgacctggcgcggtggctcacacctgtaatcccagcactttgggaggctgagtcgggcggatcacaaggtcaggagatcgagaccatcctggctgaaacagtgaaaccccgtctctatgaaaaatagggaaaaaaaattagccagacgtggcggcaggcgcctgtagtcccagctactcgggaggctgaggcaggagaatggtgtgaacctgggaggcggaggttgcagtgagccaagattgtgtcactgcactccagcttgggcaacagagcgagactccgtctgaaaaaaataaaattaaaaaaaaaaaaaaaaaaaagaaatacattggtttggtccagaaaggcaggacaactgggtgggggtgggggcttccaggctgtaggtaaatttaaacattttctggttgacaattggttgagtttgtctaaagacctgggatcaatagaaaggaatgtttgggttgagataagacattgtggataccaaagttttatcatgtagatgaagcttttagctagcaggcttcagagagaagaggctgtagagtgcttcttatcagacttaaagtctgtgttgatgtaagtgtcagagaggtataatgaggcatgtctgacccccacttcccttcttggcctgaaccagtctttcaggttaaattttaagagccctggctgaggaggaagtccctttggagggggagttagccttttatttttggtttacagtatgtttttacttcaggaccagtttgataacagcttttaaatttttacaatttaaagcaagaagtcgctgaagatcgaagaaattaatttacccaagaaaataccagaaagataaaaattagggattaaaacctgtggtgcctgatttacacacacatatatagctatgttatttttttttcttttttgagactgagtctcgttctgttgcccaggctggaatgtagtggcacaatcttggctcactgcaacttctgcctccctggttcaagcaattctcctgcctcagcctcccgagtagctgggattacaggtgcccaccaccacagctggctaatttttgtatttttagtagagacggggtttcgtcatggtggccaggttggtcctgaactcctgacctcaagtgaactgcccgcctcggcctctcaaagtgctggaattacaggcatgagccgccacgcctggccctcagctcagtatatttttaaatgcacatttactttacatttaaagcaacttaaacatacacacaaacacacacgtatcacacatattacaaaatacaagacaatcatgtggccctatcttccccccttccacagagggagacacacttacactatacaaacgtgtatgtgttgtgtgtgtgtatacaaactatcttgatttggagagggaactatttatctaaatattagcttgttttcttttggttaaataggatttcccctttaataatattctgtaattccaaaaatataataattgccatgtagtcaatgcatctcaaagtcctaaaaatatttttagaactaataggatttatactgaatttcatttgatatttttataagatctatttgatgcaaattgaatttgtattctattactcgatttttttttaaagcaaatgccatgtggaaacaagcagagagggacaagttttcccagaaggaaagttgaaaggggaagagtagagagaggttgatcaagaaaaccttcacagatgatgtgcatcttgaactgagccttggaagatgaatagtaggtcatcttcaaatggttggggatttagggtcaggaaagtgcctgtatagtaatatggaattaaaatgtcttctcacttcggaaaactctgaagaagaaaggtgatttttaaaaatacagcaaagttggaaaatcttacctccaaaattatttcttctttaataccaacaaagaataattatagttttgttcctattaatgttaaaacttgcttcctagctaattaaaatgttcattaagaattggtttcataaattatctggtctaggcctagagccctgggaccctgcaatggttaacgtatttcacaggcatcagcattttcctttcaggtttctaaggatgaggcttataagtttttatgaaattctacatgctaagatgtttaaatatgtaaaatggccattcataaacctagttcactaatcaaattagttaagtctgggagcttggaggacttccactctcaaagtttacacatttgggaatgatgagttgcaacttgtatattgaaagtgactgaattaaaatttatgtaaatgtgtcatcttagtttaataggttatgtggcagtcactgtaaagaaaattaacagaacacagtgcccatcaggaggctcttctgacataattagcacagttatatagcactaattcatgtaatgttttactattgacaattcaaaattgacaacttcttaaatggcaaacatttctctagttctttgagatgtttgtatgtgtttttgcctttgaatttattttaaacatttatatacacaggtatctctcagtatttaccatatgggatgtaattaacctaatttacatcatttttatgggaaattcaactggatgaggctgagtctgtttgtacaatataatactgagaaaaattgtcactctctgaatatttggtatatatgccccaggcttttgatattttgaaacttccaaaaaatggaaggtctttttgaaaaattgtcttggtgtagtaatacacttttgccaagaaaaaaaaaaatcaaagacttacttgccctgtatgatgggactttacaagttttaatttcaggggtttctgatgagtatatttgtaaaggagaaaaaaattgtcgcttcactgctaaccataaataataacaaattgaggttttaagatatacttgaagaatagaggacagaatattcatcaataattatagaaataatcattttgtgaacagagaatgagaagttatttttttattagctaaaggagattttaagctaggtaaagttagactgcatttaagggatagagtctgataacattcggaagtacgttaagtacagagttaagtatatgaggaaagtaagttaagcactaaggaatatattagtggactgattccaaaggtgtagggacacattatgagcaacttatgatacataagttcattagcaatggttttatgtgagttgttaaagtggggaaaaaagaattattagaaacgagtaattttatgaagaagcaaaaatacatgtacagaatccaacgttgaatatggcattgaaaataagtcttcagtgttttccttgagggttttaaagaaggtaactgagttgcatctgaatgatatatttcgttcgtaattaaatacccaggctcacttagtgcaaagtatgatagaaaatgccatctgcaaagcactgggaagagtagatagcacccaatttaaagcatgaagacatttaaatcagaggtgtctgttcatttgccatgcatctcagcaaagatatctgaggaatatctagtagcagtgaaatacatgaaaactacacgacaaaccacaaaaagtgatgaagcgatagttgctaaattgataaggaataaaataaacgtgcaattgcttcttggaagccagggtctgagtaggatccgggaaggagactgagttcattgtgcattgaaaatgtcactgaacctaaaactaagcgttggatgtaggccattggcactcagggagagtacatgggaggccttgaaaccctgcctctgcttcctcttcacccttccatcctcattgctggcataaagagatgaggctatccactggcagaatattggagagaaaacaatgctagtagctgacagttaactcccagaactctaagagatggtggtacatgttaagtattagagtgtaggctgactgcacattatgtgtggacaaaaagagttttagcaaggaaatcagagatgtttgaaggaagaagtccaaatggaagcaacataaaataaatattaagattaggttaggaatagctcagagcttgaattgtgtaagaattgggttcagtgtccacctgtttcccatgaaatcaagatatcacaataatgatagaaatgaaagggaagaactccaacaggtgagaagagtccaaactcattaatatgtttctttgttccattttagaaaagaagtataacattaacctctgtgcttatgaataggttattttccttagacaaaacgctctcctcaccactgccctagtaaaatttgaaattgcctttttaaaaatctgtacatcaaaaaacgagcgtaatcactctccatacgatctttgtataaaagggaagttcacgcactgtatgtgacccctttccaaatttataaagtcagacaaaaaattgaatgaggaaagacctttctgtagaatttcacatcctgttgtttgaattgatttgaattatcagaactacgtgccaactggtgtccaggcctcccttaaaatcttcacagacagagaagcaaacagacagttaccatggtgttgactccacaaagccttctttgtgtggagataaccaatatacttggcagagcctctaggctagaagctgatttaatcctaatttacagagaaggtgttttttgattatcctcttaaaaagaccagtgtgagctgagccccagttctgtgtctaaaccatttttatcttgtcaaacaaatgcttcactaaaccaaattacttgataatgtggactaatgcattctcgtctctgttctttatggagttaatagcatgtctggcacatagtaagcacttagtatatgctttatgaaggggaaaaaaaggagacatttgaccgttttaaaaggaaacatacaattttgcctttttcaggaaaatacacctctaaaagtgttacaagatttcttctggggccgggcgcggtggctcacgcctgtaatcccagcactttgggaggccgaggcgggcggatctagaggtcaggagatcgagaccatcctggctaacacggtgaaaccacatctctactaaaaatacaaaaaaaattagccgggcgtggtggcgggcgcctgtggtcccagctactcgggaggctgaggcaggagaatggcgtgaacctgggaggcggagcttgcagtgagccgagatcgcgccactgcactccaggctgggtgacagagcaagactccgtctcaaaaaaaaaaaaaaaaaagatttcttttggaatgaaaattatttactttcaaactaaaaacaaacaactttgtttcttttttctgcagtgaattggaggtggtggtataacagttacatcaacatgcatgttataggagcagaaaggctgtgatccctttccttcctccttatacaggtcatagcagacattcctataacaaaagataggttaacaagagaaaagcatgagatatttatctaataaaagttttaggtgacatgggagccttcaaaaatgaagacccaatgacccaaaggaaaactgtttttatgcttagagttgataaagagtagacagccatgtaggaatgtgattggacaaaaagggaatgatctgatagtaatagactagggacaaccagccaggcctgtctgtgtagaattccttcctcctacacatggggtaggaccccacttgaatgagggtcttatgatctactatcaaacaaaagtatgtcagagaattttttatggctagctaatagagagaaaggtgggcaaaatacagagttataattctggcttttatggttggctttggaggagagggtttttggtttctatgacctaccttgaagaagaagaattctggttactatgactcacttcagggaagaatgtggagttaaagacaggaggggaggagaaggtcagagggaccttggttttgaggctgcttttgaggccttccagtgttctttagttcaaagtttcagcatgccaaagtgccatactttggggtatcgttttctgagcccctacagtgtgcaaacaagagcaatgtcaattcaacgcctagtagaaatctttctccaacataggcttcagcagatttctttcagctgtcatgccagcctagtaccttgaggcacgtttgagtttcagggacctctaagtagaagtgagcaatctttcttagagatagtctaaatcaaatgagggtgagactagagagattaagtttaaagcgtgaatttgaaagtgactggtggatattcctatctcatatttatgagtcagagggtatttgatgtataattgagtcagacaaataaatttcaccaaagtggcccaaatgcattatattaacaacccagttttcaaaatatttatggaagagtcagtgaaggattttattccattggaggaggaacaagaataaagaatagctctgaattactttagaaaatatgaagcgaaatttgtttctacaagtacttgaataaaagacaaagtagaatatacagttaagaggtctatgaaggccagattataaaggatcatgttgaaattttgttctttattctaagaaaaatgagaaagtctttgagtggttttacgaatgaaggtaacataatcagatatgtttttactaccgtatatttcaaagtagctagaagagaataatttgaatgtatctagcatagacaaatatttaagattatggatatcccaagtacactgatgcgatctttacaaattatacggatatgttaaattatcacatgtacccccaatctaagtacatctattatgcgtcaattaaaaaagatagaaatgataatttttccagtagtacataaaagagagagttccataaatactgcccagaggccaagtgaaaagctattgcggtatttttggtcacatttaatggcaacacagatttgggttctggctatggagacaggaagaagcatacatattcaggagacagagaatgtatgtgtgacagattagactttgcaatacattaaacatgggaaggaagagagagggttttagttggtttgctgtaacaaaataccataaactgggtagcttataaaccacagaaatttatgtctcccatttctggagtttgggaagtttaatatcaagtaactagcagatttagtgtcttttaagggcaggcttcctggttcatacttggtgctctctcactgtgccctcacacggtggaaaagaacactgatctcttcagatcattttaaggggactcatttcatgagggctctaccctcttgacctaattacctcccaaatgccccatcttttaatatcatcacattgggaattaggcttcaacatacgaacttttgtggggcacaaaattcagtccatagcggagatgaagataacaaatatgagggatggtgatgctaattactgatctggggaatactgatagagtactagtttgagggagaagatcaaactttaaaccttggcatataatgtttaaggagattttgcagcatgcaagtggagacatccaataggcagatggttatatagctgtggaattcagaacaagtgcctgaattagagatatacatatcagaatcattgataaatagattgcaattcaaggcatgatgactgatgtgttttctggtgagagatagtagagtagaagatgattggtaatgaactaggtcttgacatctagtacataatgatagggtggaggaggatggacctgcaaagaaaaaattaccaatggtcatagaaatagaaggcaaattagaatagagtggcatcatgaagccaaaggaagaaaaattacaaacggatagtatggtcaacagtgttaactgtagtcctagctacttgggaggctgaggcaggggaattccttgaacccgggaggcagaggttgtggtgagaccagattgcaccactgcactccagcctggtgacagagtgagactccgtctcaaaataaacaaatactagaaattggatggactcagatgcttgagcaaaagtaagagaataaagttcaaaatgtaggtagtgggaatgactttaattaaaagaagggaaactcaaatgtaaaagaagggaatgagaacggtggctacatatgcgggtctgatggtgtttggaaataggaagtgaaagaagttctactctgataattgcacttgtttctgtaaggtagggaacaagatcatctgagagagctgcagaaagaggatgggccagagctttgataaaaggttttaatagttcctgtagagacttagagcccaacttgggaaaaaaaaaaaaaaaaaaaagtatggcaggatgctaggttcatttgaggctgttgattattgccttagtttgggttgccccaagagtagatctgaagagaaggatttaggtgcaagcagtttatttggaaagtgatcccaggaaacaaagtagggaagtgaaataagaaaaataaagcagccaataaagtatggcacaaatatagggatcaggttactgctggaaggaactggggctcaatcatgcagggaaccccttgagacactgtgtatcatacttcaggattgtccaactgaggggcaagggagctgggaaattcaccaattccaagctctcactggttaagggacacccctaaagtattaacattccagcactccttctctgtccaatatactggcaaatagatgcttgcagatagagagacacaggaaattttatgttgggccaaagcaaaaataaaaatgttttaagacattatgatgataaatatgcataaaagatgattgaaatataattcactggtttgggtaggtaatcaaataaccatagtaggagagtatttaaggagttaacatcgctgaagagagtgtgaaagatttttacagcatataattgtactgtatattttaatcaacattatgaatgaagaaacaggaacctgatagtcaaacttgtggataaaaaatgtaggaaagataaaaatcatatatgacacaataaaaatccataaacatttgtaatgcatacacagataacttactgacattcagtgacatgggatttagaggaatcaggatccctagtctcttaatttcaagttggatagcctcgataaataacaactcaatctgtatgctatgaaccgtcaagtttctgacccatggtattgaggtcaattaacttaatttctctgaagctccatctcatcctatgggcagctggaattggtgatacctaaccaaagaattttgtgagaatataaaatgcgaatatgtttttctaagggctttgtgttccattaatttctgtatctgtttaatttttaaacaatagcctgcaacaaatgtgagaaattctaactggtttatatgattcaaagtcccaaaactggagttcaatagatcaggtcatatgtttgtgatagtaattaggttgtgatataactggtttaatgatagtttatgtgaaaaaattcctagaagttttaagtcaattgaattgcaatgtgagttgaaagtctaatattgaagtgaaaatatttattgaaatcatgggctatatcaatgaaagtattataaaccagaaagataattattcttccctgtttattttacacactgctgatatgttccctttaagtacccaatttaaggaaactaagataacaacaagccatagaatatccgttgaagtaattaagcatagggtaggctgatgatcaggtatctactgataaatttaaagagcggatttcaaatatttataattttgtatccttttgccaatatctttccaactactctccacccccaccagctcctggaaatgaacattgtcttctgtttcttttagtttgatttttttttttttttttttttagattccacttgtaagtgagatcatgtggtatttgtctttctacacctggcttatttcacttaacataatttcctccgggttcatacatgttgttgcaaatgaaaggctattcatagtcttaaaggcttaatactattccattagacacttgggttgattccatattttggctcttctatacctaaatcaccagattagaatgaataatttatccctggtggctccaaagatctcttccaaaaaaaaaaaaaaaaaaaaaaaaaaaggtttgaaaataacaggataggtgatctgatatttatggcagcataacaactcacaccaaaatgtagtggcttaaaacagcacctatttattatttctcctaattcttcaacgtaggcagtgccctttgggtatttcttttctctatgtggcatcaactggagcactcatttgtctgtcttcagctggcattgagatgggtcacagagggctttatttgcatgcctggtgccccatgcttcttcatgtggcctcttcacatggacagatcaagtttccttaaaacatgatcacctcaaggtcattgtacttcttatataattgttgtcttctcagaatgtgtgctctaaaaagtcaagctctgacatgcaagcacttctcaaaaccttacttgcagtactcttactattgtcccatttgtgatagaaagtcacgtggccaaacccagaggcagtatgattggagactacagaaaagcatgtgtttcaatggtgaccaccaacaggaattttttttttctcataaatactttccaaaaagaaaaggttatcgtgggaagtagtactttttcaaatagtggaaacattcaagcagaggctgggtaatagcttacaggatatattgtagaagtgatttttacattgaggtgaataaaatgacctctgtgatcataagactctagatcaaagctgactccaaatttgagtctacctaacagggaaaatagtgctgctattaatactaatagaggtgtcaggcaggagtctcagattgagaaaagaatgataaatgtggataaattgctttttttaatatagaagaaagagataatcaagaaataatgacttttattttttgctgtcttaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcac

SEQ ID NO: 5617 - DNA, 242961 bp, human
cgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcagaaaaagaagatgcagtgaac

SEQ ID NO: 5618 - DNA, 276191 bp, human
gagaacctcttcagtgacctacaggatgggaggcgcctcctagacctcctcgaaggcctgacagggcaaaaactggtatgtgacttatttttaagaaagttaactttaaacttagtagaatttcagaccagaaactgacaacatagttttatgacatctagtagaatgactaggtactgattgaaacagcaatacctattccttagtaaagcaacctcgtatgattttcatttggcatactctaccgcctgcagaaaaagtaaaaatttcagtaatacaatttatattaatagatattattcagttttactacttggtatctatcttatcaaatatcttaatgaaggcttttatacataatgacttgagaaattatctttgtacttttgtgtatttttgaagttattttacaaggaacctgtatgagtttatacatgtgggatagcaaaataaggtacaggcattatagtgtaatacgtgatagcatatgtgatgaaaatatcacttcctcttgaactattatcttgtctaacttcagagcattcctgtgaagatacatgattgatatacatgattacagatcagtgaagtcatgttgatcaaggtcttacactggggggggaaagaactcaaattgaaatcccctgactgaaataatcgtcttagattgctattctaaaaagtagagtttaagcccccagtctatagtcataaataactgttctacctatcaaattctgctaaatcatagccttcgtctcttatctttgcccttcattacaactccccagcacatgcacatacacacacagacacacacagattttgtcatattatacaaactgaagctgtcgttcaaagtcagttagcaaaaatcctatctaccccagcctgcctcctgtaacacttaacgctaagccactcttttctcggtatatattgtcagatatctctgggtttttgcctgtattattttacttgcctgtatttctttttgtacttctgtctaccccaactgtctgccagaaaccttgatttcacctcagtaaagcttttcccaaattacctttgctaatttttccctcccaaattccacagaaggcccatttttgtcttgtttttagtgtatgtatgactgacatccctcctcaattaaattctgaagtcctatacagaagagacatacctatgctttcattttttatcttcagctatgtgagattaatactaaaacggatccatttttttcaagaagtctgaacttgtactaatagaagaacaacttgatgacatattgaaataataactttagtcaagggggaaaatcagatttaataccttatagctgaactgtttgctgggcgccaatttgaggtcatcatgtaaacttggtcttaatttcactagttagagatagatttgtgtgtaattcatctcctatgactgtgaacaatttacatatatatggatacgtagcatatgtacagaaatcagtgtgtctgtgtatctcgtttctcctgtattctgaagtcagtcctactttgttaccgaatacagaagtcccagtgtcttccaaatgttcgtgaaaaatctttcaaagattatggcttactcatcttgtcctggccctctgttaggaggctgttgtctcttcacttccaggtatctgcgtgatcacttctcctgtgttgcaatcctctggtcatttccctgactgagtcaatccatctatcacccaaagcaatttagtcagggttaacaaatttcatacataatgtttaagataatgaatttcagatcctttcgtaattcataagcatgatttgggtgtttatactcagatatgagataagcctttctctaaacttatgatgttggcacactacccatttgatataaagaaaaaaccactaatttcggcaaaattaaaaaatccacatgatttgcatttatgcatatacatacatagacgctaagacaaaatgaacctaattagtaatagcattaaagaaaaaaatatcaaacaaaatatccatgagattggccagtataaggtaagctagtggtagggaaaaatcaccaaacatttacacatggcagtgtagattacataatttcagatactgctactaacagaatccattcaccattgtttgtcctaatcacagatctgtcagccctggtctgaggattttgcctttctcataaagcagaatcacctctaacaaatgctcccgatcccagaactccaattcgctatgccttgtcttgaattctaatagtttctgtagagatatatcttctactcctaatgggaggcatgtatactatagaacagaaattttagtattctactcagaagcatctgcatttggattattggctcaggacatccccagggttaaaaggaaggtacttgccttacaatcataaaataagaaatactccccaaggagactctaataggggcagattttaagttcccacttcaggatcagaaactgcagctttttaaaagagtagactatgtttggttctaatacatatgcacatgtgtacatttaatgtttgaatatgatacaaaggaaaattttgctaaatcttgtgactatataattacataattgaaaggaaatatgtggctttggtctaactactaggcagagaactgatttgagtaattattttcaaaactttaaagtcctataattaccattaaacttgtatactgtcaatctatatatacacaagaagattggttatttgctgtttttctttcatgtattttttttttattttgatggaatcttactctgtcgcccaggctggagtcagcgacatgatcttggctcactgcaacctctgcctcctgggttcaagcaattttcctgcctcggcctcccaagtagctgagactacaggcatgttccatcatgcctggctaagttttgtatttttagtagacatggggtttcaccatgttggccaggctggtcttgagctcctgatctcaatgagccacctgcctcagcctccccaaatgtctggctgttgcttttttttttttttttttttttttaaatctaaagtcttatttttttcctctttttggtggaaagtgggagaaatatcagaatgtaaaccaacatcattctgacattcttggaggaaaatctaagaggtaaaaatggagattctggttcataaggttagccttaatgttttgtgaaatcaaaggaacaagatgtcaatactgtgttataaaggatatcaggcaagttaccttggagagtaagatggctttagcttaatttgggttgttcagcaggcagtgcaaatgataaggagttctagggtgaggaactacttgagaaagaccaggagctttgctggaaagtataggagttaaatgcaagacacagaaatatagatatttgtttggtgcatgcacaaggtagttagagaagaaggaaataaatttgcaagactggggctctacagacacagacaaaagtttgggtcctggctccaccaattattagttatatggtaatctatatattagatattttaacctgaggttcacttctgtacaatagggatgaaactaactgccttgcaaggcggggattaaaggtagtgcattcaaagtacttggcacatactacgaagtcaataatatttatgttggaccaactatgtgacaagcaccaatcttagtgctttatgcatatcgacacactgaattctgccagaaaccatatgtacaatggtttgagcaatatgaacaataagtagtgccctggacaaggtctggatcctgtgagacagcatgcttcatgtttgagtgagggctttgacctcaaatgcagagaagaaagtatgtcgaattctcttgtaaatcagagcagttgttattgagagcacatgttgtaacttgtgtatgcctcttgctaatattttcattaagtccatttttaacagatgagaaaactggtatacagggagattaaattttttatgtaggccagacagcacaaaaacagcagagctgacaattgaacccaggcagtcagctttgtagctcttgcccttaactgttacctataatcacccaaatgtttaggtgagaactttgcaagtggtttgcattggcagtgggcttacttcaggaacgtcattgttgatggtatgaaggaaggatgaaaaaaatggtgagtgagtggagaagggaaagaggttagatttctctgggcaatagctaataagggcttgtagtaaggtaaaagaaatgaaaatgagagtaaataaaacaggttatcataatggtagaatttctaaaactctacaacttaataaatgagttaatttgtatattacaatgaactatgcagatgttggtttaaaaattacaggataagatacaacttttgggattgagaataaaattagggaaccaaagtgattgaggtttagagcttcagtgacaaggacaattaaggtaatcttcacagaaaaggtttcctttaaccctatttggcattatataattttgctagagtcaaatctcctttagatttttctaaaaagtttgggaattgtttttctatcttactagaaaatgtttttatgcatgctgatgtttctgtcattggtggtcatgcagtaatccccaactgggctatagaatgaagaaacaatcataccaaaataggctttgtaaagaaaaagtgttgccattcttagagtggttggtttatgctaaaaacgtaccaggccaaggacaattagcgcaaagtatttagattcattatattaatgcctcacaggctctgttcgtttacaatattcaagcttaatagtgaaattataaatggtttcatttctagtagattgtcggtctctctgctggtcagtgaacactcttttgttttgttctcagccaaaagaaaaaggatccacaagagttcatgccctgaacaatgtcaacaaggcactgcgggttttgcagaacaataatgtaagtagtaccctggacaaggtctggatgctgtgacacagcatgcttcatgtttgagtgagggctttggccccaaatgcagagaaagtatttcaaattctcttgtaaatcagaccagttcttactgagagcacatgttgtaattcgtgtatgcctgattgtggctaatataattcaggaagcaaatgcatgctgccacagagggaagggaaaagacatagacctgacctgataggctgctccctgttttcagattttacttcatgaagctgtgtttggtggacaaagtcctgcagtcaactcggtttcttttcttactttgcttttctttttcttttttcttttcttttcttttcttttctttttttttttttttgagatggagtctcgctcttctgtcccaggctggagtgcagtggcgtgatctcggctcactgcaaactctgccttccaggtttaagctattctcctgtctcagcctcccgagtagctgggattacaggcacatgccactatggccagctaatttttgtatttttagtagagacagggtttcaccatgttggccaaggctagtctcgaactcctgacctcaggtgatccacctgcctcagcctcccgaagtgctgagattacaggcgtgagccaccgtgcccggtgaactctgtttcttacggcagtgttttgtgcaacaaacggatttttctataccaaatatttatgtactaaatgtgttcaaacctgataatgatgtttgtttaaatcaagccaacacttattaaacgctgtctccaagcatataaattatacagaaacatcactatttttacttggggtatgaatggcagatttgtttttttggtttagatttaactggattaaaatacgtgtgttgcattagaagaagtaaacagtcacagctaaaccaagtaggcaggtcagaggaattctaatctcctctgaaccacttggtgactcttcccctgtgtcatggcattggaggcagccttcctttcttattaacatcctaaaatctgtctaatcgaccaatacatttcaccaggcacttagtagctccctaattacattacctctctctttcaaagataaactcaagtacattgagtacgttgatcacttactcttaaaataaccataagcagggatagattaataataacatgtactcccccaaatgttgctcagcttatctggcagggagatgacattacataagatatggaaatggaaactgtgcagcaattaattggctgattttatgaattcagggtcattgtcacctttaacctatgaaagttattttacagagatgtttgtcttaggaagaaattaactagatttttcactccgcagccagaataatctatgagctgattttcttgtttattagtccgatggactctttggaaatatcagtgtcattgacattatgagaattgttaacaatattaaagttacacaaagaaaatgtctttgaaatatcaaaatatcatattctgtttcaaaatgtagcagtgaagaaaagagcggaacacagaattattagatttaatttatttgtagcttgactgtccccagcaagaaaatgtcatttaaaaaaacaaactttgggatatcctgtaaaactcaatcctgcataaagaaaatgcggtacaggtcgggcgcggtgctcatgcctgtaatcccagcactgtgggaggccgaggctggcagatcaccagaggtcaggagttcgagaccagcctggccaccatggcgaaaccccgtctctactaaaaaatacaaaaattagctgagtatgctggtgcatgcctgtaatcccagctactcgggaggctgaggtaggagaattgcttgaacccagaggctgaggttgcagtgagtggagatcgtgccactgcactccagcctgggaggcagagcgagattccatatcaaaaaaaaaaataataataatttggtacatatacagcatgaaatacaatactatgcagccacagaaaagaattagatcatgtcctttgcagcaacatggatgagtctggaggtcattatcctaagtaaactaacacagaaacagaaaaccgaataacacatattctcaataagtacgagctaaacactgaatgcacacgaacacaagggaacaaagagccagcagcagctagtgctggggaactttgagactcctacgtgataaatcatgaaagggtgtatggggggggtcttacttgcaagtatgttttgggaggttttttgggcacacatgctctggttgtacatgctagcacacataccacatctcattggcatctaaaatctccacccaggggtgtgtgggtttttttgtttgtttgtttgtttacactattacaatgagcaaaagaatagggcaagtttttggaggagtgtgtgcatgcttgtcagtggggaaaatccctagcgtggttatctctggcgagggcctgagaagtcccctttggggctagaggagcccaaccacaaggctagacataatcagtgtggacagtgtgtgtattcattgtccgtttcgctgattgtcaacaggcagcactgactcagtgaaacagcatcttcaggacttcttttctcaatggggctcccttgcctgctcatttctggctatctgcctactccaagggaaccagaaaaatcctggcaataaaacatatagaaggaaatttatatgactttgggataggcaagtatttatgatacctgaatccaaagcatgtttcaaaaagagaaaagttaacttggacttcatcaaaattgagttattgctatattctggatatgagccctttgttttgagttgcaaatgtattttccttttctgtggattacctttttactcacttcaatggttaatattaataaaaacaagttctccacttggatatagtttattctttaaaactttatatttttatgacctgttgaagaaatactggcctacccaaagccattatgatactatattaggttattatctatagaaccattatcgttttaccattttgtttttggatctgttttacctgaaattgattattgcatatggtgtgaggaataggttaagactcagtatttattttatttgaagtctaattaacacaccatttattaaaaataatgcttcctcattgcttcacagtactaagtgtgtcattaaaaatttgtccgtacatatgtgggtctgtttttgcacttcaattctcttgcattgttctctctctctctacacacacaaatatcatgtaatgtggagtaatgtagttttataatacagcctagtatctggtgaactaggttctcccactttgttcgagattttattggttattggccctttctatttttgtatttgttttgtaatcttttccatttacatgtacattcattttaagtatgattaacattgagttaaatctatagagaataactgacacatttacatatggagtatcccagtcttctgtttttcttgattttttttttaaattttaggttttctagaatgagaaactgaaattgaacaggaacacaaaaggtgttcacaaattcaagaatcatatttaagaaatgtttaacctcagcagtaacttgaggaaatttaaattagagctgtaatgagataccagtacaaaattaccaaaatgactgaactagactactaatgccaaatgttgatgaggacatggatcaactggaaatctcacaattaacttctggaaatataattcaggcaactaattaaagagttgggcatgatctactaaatgtgaaaatgcacatttcttaccacccagcaattctattgtagacatacaagttacagaaatacatttcccagtttgccaaaaacacatatatatgtgagaatgttcatagcagtttcatttgtgatagcccaaactggaagtgactatgatacattctcatgatgggatattacagagcaatgaaaatgaccaaatgatagctacacacaatatacaagatgaagtcgttaaaatgtatttgagtgaaataaatcagacaaattatacctactatgatttctttcaattaaatttcaaaaacgggcaaaatgtttccatgggtttaaaattgaagagagtggttaacttttggaaggagtaagtcagtaaaacgcataagagaatcttctgcggtgctcactgttccatgttttgacctgatagctgttacacatgtgtatttactgtaagaaaacgcatcaagttgtacacttatgtatatttttctatatgcatattccacttcaattaaaagaggaacttatgaagggaacttaaaacctccgaaactccacgggccatatatagaaatctgatcatagaccccatgttttctaatgaaattattaaatgaatataagtgaatataaaattagaatatgatgtcatatgaatctcttcagggaaggccacatttcttacagaaaatatagaacctcctaatgttttagtagggaaaaggccccaaaataatggcttaaatttgagaaggagttgttcaaaagcagatattaacaatgctttcatctgagctagagctttaatggggagctgcataagatgctggcctatgcgttagaggacaaaacctcaagacattctcatgcagaaaccaaacttggaacaaaggaacctttaccttagcctgtggctgaacaataacacatggattttcaaaagtaaatctaggctgggcgcggtggctcatgcctgtaataccagcactttgggtggtccaggcgggtggatcatgatgtcaagaaattgagaccatcctggccaacatggtgaaaccccatctctactaaaaacacaaaaattagctgagcgtggtggtgtgcatctgtagtcccagctactcatgaggctgaggcaggagaatcacgtgaacctgggagcagaggttgcagtgagtggagatcgtgccactgcactccagcctggccacagagtgaaaaaaaaaaaatgcattatcttataattctccattttgtcataagtataaacaaaaatggaaaacatccataagtacaactttagtttgcttattaggaagaataaatcaaaatgctcaagcaggattttttttctaaagttgagcttgggtgtgttctatatcaataagcctgtgcaggatataaataatcacattgaagaagtcctatccaaatttccttttaaaattcacaggtatataagttgattgattggtgtcagagcaaacacaaccctttgtgtgtcagagattacagccacatggtaggcaatatgaagcatatatacttaggaacagttaagtgaataaaaaagagatacatagaataagaggtctgagaagaccttttggttcagttcctatatgagcagagacctggagaaagggagtgagccttggaattgtctataggaaggtgggttaggcacggtaataaagaccttaaggtgaaaaagcatttggaatgaggcctcagcaagtggagtagagtgagtttagagataaaggaaacatagcagagataggggagcagagaggtagtaaggtgggggtgagaagaagaaagcatggtgagccattgttggcatttggactcaggtctaaatgagatgacaatgactaaaaaaacactactagaaattaaatgggtcataagtcaggttattttaaaaatcagtaatagttccaagtctttgctattgtgaatagtgccacaatgaacagatgtgtgcatgtgtcttcatagtagaatgatttataatcctttggatatatacccagtaacaggattgctgggtcaaatggtatttctagttccagatccttgaggaatcaccacactgtcttccacaatggttgaactaatttacattcccaccaacagtgtaaaagcattcctatttctccatattctctccagcatcttttgctgactttttaatgattgccattctaactgttgttaaatggtatctcattgtggttttgatttgcatttttctaatgacaagtgataagcattttttcgtatgtatgttggccaaatgtccatcagtgatagactggattaagaaaatgtggtacatatacaccatggaatactatgcagccataaaaaaagaatgagttcatgtcctttgcagggacatggatgaagctggaaaccatcattctcagcaaactaacacaagaacagaaaaccaaacaccgcatgttctgactcataagtggtagctgaacaatgagaacatatggacattaggaggggaacgtcacacaccatggcctgtcagagggtggggggctaggggagggatagaattaggagaaatacctaatgtaggtgacgggtctatgggtacagcaaaccactatcgcaggtgtataactatgtaacaaacctgcacatgtaccccagaacttaaagaataataaaaaatataaaacaggaaaaatcagacaaaatgaaaaatcagtgatagaatactaacaaacttagagtgtcattttattcaagaaagttacagtcaataacgaaaacgtatcgcacagtagaaatgctgctaaatccatgaagaaaaattgatggaaatatatttttagagccattaattcaccactgtcaagtttatgacatatttaacagcaaaagattgagagtacaaataactgtaggtttaatagtgattttctgtatctcaacactaaagcatagtagatacttctataaaatatgagcattatcaataaatctccctatgaagttggatgtgcaagaagagcaatagtttaaaaatttcagttacattaactaaattcaagtctgaactctcaacaaggcattcagaaaatcgtatgtctgtcattattgggaatgctctcccctgagcctatggaatggccagagctcagtagatccacatggtgtctttcatagggcaaaagcattttcattttcagttcattgaggcaaccaagtgatacattcactatacaattttaaggtatcttgtgaagtcaagtgtattaactgtcctgatattaaacacgtggcatacagaaaaagttgaagagagtgtaatcaggggaatatttatagaaacgtggggaggattaaaggaagaaactatggtgaagaatgcagggattcacatgagttaataacctttactacatctaaacctaagcagtcaaggggagagggctattaatttgataaaatccctcatgttgggagagcgccactggacacaactgtgaactgagcccctaggtatctaaagaatgctgttagtttcaaatcattgcctggtgaagttgagagaagtgataccttagtctctccatagaatcctccagtgttttgccagtgccgctccttagtttagtctaaccagaagtccaaggttaagagattccaggtgatgtagtcatcacatacaaagaagaggtgaagaagtttggtgggttagtgaagtaggagtggaaaacggtataatcggcattccaggtatctagttctgttttgtttctgtgcgaaatgaggacttgagaatctgcatgccgagaactctgatgttggctagggcccagtcttgttggatgcatcaggaagccagtcacctttgaggccataccacttctatttgatgacagagagtagacgtggtttctggctaatttggggactaaggactccttcctattcttctggagacaaccagagccagaaaagaaagacacgctgagagtcacttcggatatctgctcttcgtcgtaaacttgttaaaggcttaggaaaatagtaaaaaaaatttcctgccacatacacaaattataaacgggcaatatatttgaatgcagtgaaaatgtcattaaatacacacaaactttcaaaattcatgttatttaataacagtagaaactaataatatacttataaattaagtttgattaaggtttgttaaaccaagagtataaaactacatttgtgaaggaaaaagcattccatatgaaaacccatgagaaatggctcaggctgtactgagagtttgaatttttgtctttgattttgatcttcattaaaaagataaattgaatcaagctttcaaataaaaatgttacaaaaatgctttaaggaaagcaggaactaaagataaagaaatagaagaaacactagataaaatatacagctagttccttataatatgaaatagattaatatcttatgaatgtgatccagacaaggagggagaaaaacaaatgtatgcagtttaaaaatggaagggaaatattaagtatgagatatagaaaccaaaaacgggttttacacagaaatacatatatgtttattataaaaaatgaagttgaggccgagcgtggtggctcacacctgtaatcccagcactttgggaggctggggcgggcagatcacctgaggtcaggagttcgagaccatcctggccaacatggcaaaaccccgtctctactaaaaaaaaaaaaattagacgggtgtggtggctggcgcctgtaattccagctactggggaggctgaggcatgagaatcacttgaacccatgaggcggaggttgcactgagaggtgatcataccactgcactctagtctgggggatcgagcaagacttgtctccaaaaaaaaaaatttttttttgaataccagtgataagtttgtccacacaccaagaaattgataattgctaatagaaaatcatatgaacagcctcctaattctataaacctatgaaaagaaaccctggtttaaaaaaatcactcaaaatttagccctctgatttttaaaggaatattagaagtgtcttttcaaaatgatactttttggtaatttctggatcattaagtcaaggtcattttgtcttctctcttttccttagggtctcctccattttagcctgtccctctgccataaatcactagttctagcatattctgtagttctaaactagctcctcagtttaaccctgttcctcagtttctttcctttccctgtcctggcgtttaacctgttatcctcacttgaatgccactcagcttatatctgtagagctcagacactacgtctgtgttccaatttgcattctttgtggtggctgttttagcatgaagttatccctgctgtcaataatgtattttggaaagccacttattgagaagaaagtacttctaagtgcagtgataactttattgcggtatttgctgagagcaaagctcatttgtaatagttggttgtgattttaaaaagcgaacaaaatacaaaatcctgagaaatgggagactatgctactaagtggttattcttgtctctacatcagctctaggtaaaaatgtatccacagcttctttttatttacaagtttttgaaggtaaagcaaatcccagctaggatgaaacatctcttatacagccattctattatttctttgccctgtcccacttttgtttgtaagtagtgcctttcattaggcattttaaattcagttctacacttaactctattctctcaaagatatttaatgggtaatttaaactttccttggatataactaagttctaatcagtgagtattctctattagatatttgcacttttaataattttgtgtctagtttaatgattaattttttgtctggtaaaggaacttagaaattacaaatttgatagagatttaactgtggtgctttaaactaccccccgctccccaagatgtattatgatctgtcttcctttctccaagcttgtgtcctcgtcttccctcttatgatttccttgcttacattttatgaattccgatcccttttataaagattcatacaaaaggtatagtgttgaaatataccctaggaacattaccaagacttcgctgacttaatataatttaatattaactgacacagttgtagatctaataattatgttcattgtaccagctcatcaattgtctatcacaaggtggtaagtttttaccaagtaacttcaaatctacaatgtgggatactacaaagcaaatagtcattgctatacattaaatcacaaatccaaggtgagtatttaaaaagcctagggtggaaattcagatgacagctatgttcaaatattcacttaaccccatcattgaaaatagtcactgaattagattgaatggttgtcagatgtcactgatctgaaaaatgatatactgttcacatgctggcatataatgttagataaagaggattctaaaatgttctttaaaactagtattttatgtgtcctttaagtattcagaaacttaaatagccatataatacatattttggagcatgtcagaatatatttgactataaactacttctatttattactcataaaatctagtatttaagtacaaattccaaatttaatttgttagacaagtatttcttacacaaaattgtcagtccacacaataggcctgtaaaatatttgcactttatatgtattaattctcaagtttgcagaagaggtagatcttgttaactctgtaacttatcaactatagggtctttgccaaatgattccgtgactttgactcactttatcatctgcgaaatgcattaatagtaaatgttcacttctttcaaaatacttgttatggaagatacaaatatacaaacataatctcgtattcattaaactcacattcagttgcaaggtaatataactactcttaaattgcagcatgttctcatttaaaataattttctgggtgagttgtttattcttcccatcccccttagtatacctcttgctttaagggaaattagtattgacacatttcttgtatattcaacttcaaattgagatagccagttacctattatgttcacatatggaggtctgctgggataataattatataactataaatagtactgtttaaaaatatttcttataatgtcactcaagtatcttttaagatttttattgtagctattgcttttttttttttttttttacttgaaattagtatacgtgacttgagcttaaaaagttggggctatatgggttgatttttgtcgttaaagttacatcctatattgccagataaaagatacgtaattacaaaaattcaaattaaataatatactgaaagtatatatatctttcatactaaattgtgaaagtattgaggacagtgtccatttactcaggcaatgccctctaatatatattctatataaggaattttgttgagtttagttaaaagagctactttcccaaaaagtttagtttgcattttattaatacgttcaaccagattacctgtatcaaaacttctattttgataaatttgttttaatgtctttcatgccattaaatgttcatattttcttaggattatgagacacttgtattaactgcctcaattctttattgtcaaagaggcagtatataaacaaatgaaaacatgactccattaaaaataattctcctgcaatgtatcagagtgatcataaacatatctgaaatatagaggaaatttaacatttcacttgtccataagcaatttgttgaaagtctattttttaaatttattcttaacattctatgcgtggcatatagtgagtggtcaaaaatagttaaagaatgactaaatatgtaaaacttaatcattgaaggtagagatagtatctttgtagtgagtacccagaattaaatcttgtaatatagttgaggtcaaaatgtgcttcaaaaattatctaatgtaaatttctatatctgaatcaaaaataattcttgaaatacggagataaggaagggaataaaaagctgtcattggaaatccaggtccacagtggcaatatggcccaccgtttaggttgtatatatcgacgtatttatgatttaataagaaaaagattcaatacatgcatctctcaatggaagaaaataggtatgatttatgcccataagtcttgaaattttaaacagtgtaaatcttaaatgtggtgtaaaagcacatgctgcagggcaatgaaactactttgcctttcctgtattttttatctttttaaaatgcattatatttagaaggattgtatgaatacttgagaagtttctcttgaatatggagaagtctttagcttggctacatgatggcagacatcttataaaagacatttaacatgtttaaaaagcaaattctgtttatctagaatgttggaaggaacttctcggtttatatatattttatgagaacgaaatgaaatgaaaagaaatgaaagaaccaaatagatggtggaagtacatgcttgaggtttcagtgtcaggaaggatatttacataataattttcaatgcatgggatttcccttttagttattgtttaagattctgtttaaggaaatcaactcaaacttttaaggatatttcagggttcctttcagaatctttttgtgaaattattttataatagtttgtaccatttcatatctagttaaaatcaccaagactgagtgaaaaggtagcttacccttatccccctcccttagctaattttaaaaatgcttgtattttacactgcatatgagggaacaaaagtgactccttcttaggacaaatatcaaactctgaaatgatctgggagaaccaattcctttgaaacaaatgtgagaaacgacctgctttagtctaatttcaattggctgaatgacgcaggacgtgttttcattagagcctgtagctctgaaatgtccttgtcactggttgtctaaaaaggcaagaagaggcagacaccatatattataaagatgatggttcccctgtgaatgagatataactttctgcaacttccaagttaaaaccgcaaatgcttaaatgatacacaaaactctaaacatccatctctctctgcatctaacaaaaataaaattgtatgaaaaaattcattaaagctttgtcagaactttgtcacctgtctttttctctctctcatacacaaaccacacatcacacacacacacacacacacacacacacacacacacacacacacacacgtaaatatcttacaggaatgtaactcttagttttattcatcattttcccttctctctctccttctgctctgccctaagaacttccattttcattatttgacttggttattgaaattattttcaagttacatgcccctcattctgacgtcttatttactattttctgtttgatgaaccctagtctgctattcttctttctgtaaagcaaatcaaaaataacactaacttgttcctgtcaataatctttcagaaaaccatcatatttcaggtttactttcatcttaagtttttcttaagtattcttaaatcttgaatatatcaatataataagtataaatccttttactgtaaaccatcatgggatatctaatcttagcttgaataaaatattgacgatggtagaaattacatccatgttcctgaaggaaagtgggataaaagaaaacagcgaggttttttgcctgtctcgaacaagcaaatgacgagaattgttcctcatagcccagtcatttaggaggtagagtacctggaagtaaatgctccctgaaatgattatatattaatcttagaattactaaatatatattgttatacaaaattatgtattgtaagtactagtctggcgatagaagagggacccccttaagttcttgtcctatgcctttaaaatagacagcaggagactactccatactaaagaataatttaatgtattaggttttctatgtgcaattcttacagactgcttattgtaacttgaggtgtttctaaagagttcacattttaatattctactggagtcacaataagtttccattatgtcaaagcaaaccatggaggttttctatcctccaaaattacatttgaataaagcaacttccgaagataacagtgtaaaactctgagacagcatcccatgttactttatgagtaaaatcttaggcctgttgacaggaactacaaaagccaattgtgctgcgtagtttaacttatttctgcaaaaactcaaggcatgttattacattttcacacagaatatcaattttcacacctattttggtatcagatgttttcattgtgcaaaacaggaaagcagaactttgggtaaccacagtgaccctactatttaatttccaaccatagagtgcttgtcacaacactgatacacacagtaggctcgtacattaacatacatgtcatattaatgttttctgttttgcttagtagacagatgtaatcattcacttcacacagattttaaaaggttttaatatttttaccattcagttatttagcaattagactgataattcttgaaagacataattctggaatgtgtattagaaaaaaaaacataaaagagaagttactgtatggcagggtgatgattatttaagaggaaatagtactgaattcagaaaaatgttatgacttacagctaatagtaagaaatacagcattataagagcaacaagcttatgagaattcatggccaaaacagaccagaccgtcaatgtgaggcattgaagagtaatataaatgccatgaacaataccctttcaggcatgacaaatacctccctcctctagagtcttcatggttatcaattagcatttcttacactccttggtagtttgaagaagacatgtacaagagacaaaacacaaccaaaataaataataatccttgtctgtatcatggtgtgaaatgtttattaacttggagagagagcctcttaaagctttttgtggagaattcactagatgtaattaatgaaatatcttctatccagacatagttttaaatcagaccttgtggaagcttcatttatctttgatactctgtttccctcttggtaaaatgcacataaatgtaaaatgttcatgaactcttggtaaaatttatatagctcatacatactctaatgatgtaggcatagtgaaatctgtattcagagagaactgtatagccataagatttttaaaagatggaaataaaagaagtatgcatcttaagaaattgtaaaaatagaaacaaaaataaaaattgtattcaacgtagaaaattgaataagaataatccattcaaaagtgagctcttgaaaagattaacaaaataggtaaacctatcccagtcataacaaagaaaacttagaataaaaactagacgagataaatgagaaaagacgcatgacagcagatacagaagaaatgaagtggaaactaaaagcaattttataacaattttgcaaaattctggaaaacttgattttctcgtacaatacaaatcactaaaattgagataagaataagtggaaaattagactgattacttcagaaaacatttagtaggttattaaaggtgtactgttgaagagtgtagtaggattctttacaaatgaatttaacgtaacccttaaagaataatttatatactttaagctattccaaagcatatgaaaagaaaaaaactccacaattccttttgtgatgtcaggttaacctttgtacttaacagtcaaaaagcaaagatcataaatctgtaagacagttttacttttgaatgaaatacaaaattttgttgaattataagaaatataatcacattttgcaagtggtaagcattctacaaatgttatctcttatttaccaagagctcttaaaattcaagaaggaaaagaaaactaccatatagaaattaatgagcaaaacatattaacagacaattcacacatggaattgtaataggtcagtgatacaaaaatatattcaaatgcacaaggaatcatggaaataaaagttaacaaagtgatgtatttgatcatacaaacaaaactaaaagaatcaaaaacaaaacaaaaatttcctggtgagagaagagcctattcttatacattctggttaaaatatgtaattctaaattgtttctaggaaggcaggtggaaacacctactaaaattacatatatatgtgtatatatgtgtgtgtatgtatatatgtatatagatgtatacatatgtatatatgtgtatagatgtatacatatgtatatatgtgtatagatgtatagatatatatgtgtatatgtgtagatacacatatacttgtatagatatgtctatatctccctgaaatgatgcgtatatatatatgtatagatgtatctactagagcagagtgtgtgtgtgtgtgtgtgtgtatacacacactctgatccagtatatacatcctgtgaattgttataataacagtagaagcatcagtatctgaaaatgtatgcataagatattggccaggtgtggtgactgctggtgggaatgttaatcaattctgccattgtggaaagcagtgtggtgattcctcaaagaagttaaaacagaaataccattcaacccagcaacctcattatttggtatatacccaaaggaatataaattgttctacgataaagacacatgcacatatatgtttattgcagcactattcacagtagcaaagatggggaatcaacataaatgtccatcaacagtagactgattaagaaaatatgctacatatacaccatggaatacaacccagacaaaaataagattgtagcaacatggatgcagctggagccgttatccttagcaaactagtgcatgaacagaaaaccaaatatcacatgttctcacttataagtgggagttaggctgggcgcagtggcttatacctgtaacctagtactttgggaggccgaggcgagcgggatcacctgaggtcgggagttcgagaccagcctgaccaacatggagaaaccccgtctctactaaaaatacaaaattagccaggcgtggtggcgcatgcctgtaatcccagctacttgggaggctgaggcaggagaatcgcttgaaactcgggaggcggaggttgtggtgagccgagatcgtgccactgcactccagtctgggcaacaagagcgaaactccacctcaaaaaaaaaaaaaaaaaggggagttaataacaagaacacatggatataaagtggggaacaacagacactggagcctactcaagagtaaaaggtgggaggagggagaggatcagaaaaactacctatcaggcaccatacttattacctgggcgatgaaataatgtgtacattaaacccccatgacacgcaatttacctatgtaacaaacctgcacatgtactcctgaacctaatataaaagttaaaaaagagtagctgtctgccactgaatacaattctgtccctgaatataatatctccaattcccaatcagttaattaccccctagtgatctgaatgctttctggcatgctttctccacctgatacttttcttcattccaatctattttttctttacagatttaatcaatactgagtacatgaatatatcttatgtcttttgcttatcttttcacaatgttacttcctttttcttaccccttgggcttccgtgagacacagttgcctacctaattgtttttcctgtggatatagataaattttattggaaaaaaaccatgaacatttatttaggtattatctgtggctgctgctgtgtgtgtgtgtgtgtggggggggggtgcgatgtgtgttccaatgacttattttttattgtggtaaaatacaaatgatgtaaaatttaccatataactattttttattttttaattagcaaaaaaaattgtatataccatgtagcatatgattttttaaaatatctagatgttgtggaatgcttcaagctaataaacatatacattaacttatatgtttatcatttggggttgaggacacttaaaatctattctcttagcaattttcaaaatacaatattgttattaaccaaagtcagcatgttgtacagtagatctcttgaatttattcctattaaatgtaatttagtatcatttgaccaacatctgcctaaccctcctcctccaagctctatcccctgctaaccaacattttactctcaattctatgagctcaacattttaaaatttcatatacaagtgacatgatgtaatgtttgtctttctgtgcctggcttatgtcatttgacgtaacgtactctagattcattaatttcattgcaaatgagaggattctctgctttttaagtccgagtagtattccagtgtgtgtgtgtgtaggtctgtatacctgcattttctttattctttcatctactgatggacacttaagttgatttcctatcttcgctattttgagtagcactacaatatacattgaagtgcagttatttctttgacatattgatttgtttcctttggaatatatacccagcagtagaattcctgaattatatggtagttttatttgtaattttttgagaaacctccatactgtttttcatgactacaataatttacatttccaccaacactgtgcaaagattcctttttctccacatctttgccacaacttaccttttgtctttttgataatagccattctgtgtgatgtaatatttcattgtagttttaatttgcatttctctgatgattagtgatgttcaacattatttcatttatgtgctggccgttggtttgtcttcttttgagaaatgtctattcaggttcattgccctagatagggtttgaggtatcattttttctatttttttagtgtataattcagtggctttaagtatatttctgttgttgggtagtcatcaccgctatccatctctagaatgatttcatcatcccaagttgaattcatactgattaaacgattactctccattttcacctcccctagcctttaataacttccattttttctctatgaatttggctattttaggtacctcatataagtagaatcatacaatatttgtcattttatgtcttgcttatttcacttagcatatgtttccaaggttcatttatgttgtagtttgtatcagaatttcattcctttttaaggctgaaaatattccgttgtatgtacataccacattttgtttatccatttatctgtagatggacatttgggtgttctcacattttggctattgtgaataatgttactatgataattggtctaccaatatcttaatctctgtttttaattattttggttataaacatagaggtagaattgctagagcctaatggtagatacttttttattatgtgaccttctgttgtgaactttttgacactgggggggtagtaccttactttcctttatcaggtctgagcccagtacctgaatatagtggaaattggaccttatgagaccttttatgaggacaaggaaatggaggaactatcttcctgcttacacagtgacaagtcttatgacagtggataaggggttactggaatctaagttcctattacttgatctaagtctccccagagtcaggtccatggcaacccaaaacgtatctaccagcagtgcttcccgcagtatgagtgagtatgtttcctaaaaatagcatattctctgcttaactgcttgagtctttagtgctatatcatctgattgtcactatcactagaattaagtttcatgaaagcagaaggtttttacttttacatgctcttattacttcattgcctggcagatagccaaaaggtacttgttgagttagtgaatcaatgaatcaatagataaattcatagtggcttttccttatggaggaatttctctcctctactgccatatgaggaatccccagatgatgatgcagatgatgatgctttcttattcttgaatgatcaatctccccttcgatgtagtaacatcttataaaactaaaatacgatatcatgaccaagatgtcaacattcataaaaccaccaatagtattcagattttcccagctttactcatatttatgtgtatgtgtgcatgcatatgtgtgtatttagttctatgcaacattattacgtgtgtaggtttgtaaatccaccatcagagtcaatatgcagaacagttccaccattacaagggtccctcatattgcccttttataagaacattcagctaccccacatcttactcccattcctgacctctgccaactgctattctgttctctatttctgtaactttgtcttttcaagactctcatagatacggattcatacagtatgctaccctttcagaatgactttttccccacttagcataatgcccatgaaattcatccaatttgctgcatgtatcaatagtttgttcttttcattgatgagtgttattccatggtgtggctgtactatggtttgtttatctacccctgagggcatctgggttcccagtttggggctattacaaataaacgtagtatgaacacttaggtgcaggtttttgtgtacacatgtgttttcatttccttgagataaatgctcaagagcccaattaccagattgtataataagtacatgttcagttttgtgagaaactgccagactgttttccaaagtggctatatcatttgagtttccactagcaggggttgagtcatccagtttctccacaccctcaccagcattttatggcactattttttaattttaaccattatgataaatgtgcagtgatacattattgtggttacaatttgcattcctctattggctaaaaacattgaacatcttttcatatgcttgcttttcagatgcttgtgtttaactttactccaccttaaacatttgaggagtgtgaaggacaggagacacagagatttgccttgattaaggcaaataaaaccctgccagattttcatttccaaacacagtcctagacagagataagagagctggcagtttgctccattgtttattagagacctaacattcattctaaaacagaggcgttttactaaaatgcagtcagccttaattataatggcactccttggagctaggtggaagtactggtgaatttttctgagttgtaattccatactagaaagcatatcttaattttaaacatactttatgacattttatttggagatactccagttgacctctttaatctgcagtaatctattcatgtgctgaaagtaaatatatttggggtgcttgtttgttatggaaagtgattttacacatgcattttgtttaatttttagattattttcaaaaagcttcaatgctaagtctctgaaaatagctaaatgcaattaccttcacgtttttattattattattattgcaactaggcatttggtctcttaccttcaaatgttttacccctttctttaacaggttgatttagtgaatattggaagtactgacatcgtagatggaaatcataaactgactcttggtttgatttggaatataatcctccactggcaggtaagaatcctgatgaatggtttccttttgggtaacattaatcttgttttttaatttttacccttgacgtgtgaaacaaatgtgtatttctaacaataacaaaccctgctccatagtgctgctttttaaattgacactaccatgtcgtctgaaatgttaaggatcatcacggtataaaataggttctggtacatttacaggaatatttttcaaaattttatttcattgagtaagtataaggtaaaaatacaaagtcccaatcataggtgagtaatttttttcacaaatgtatgttctataacttgtctataagttaatttagtatgttttattttaatcactaccaaaggaatgaggctttctcagtcttgggtattcttaacataaattattgccaataaaagattagtagaatatgggtatctctatcaataaatgtgtgtaatacatacaaactccataatgtgatttggaaattatttttaagtcacctgagcatagggtcttccgactgtctatttgacctctgcaaaatgggttgaaggatttgtggaaaagatacagacacacacccgtgtgtgtgtgtgtgtagtatatatgcgtatatatataatgtgtctatatatacacacatatatacaatatgcatgtgtgtatatacacacactcatatccacacattatatatgtatatatatacacactcatatccacacattatatatgtatatataagaccaacatgaacttatatccactaatattatccactcattgtatacatatacataatagtataatcataatatgtatacataatcatacatgaacttatatccactaatattttccactcattgtatatatatacgtaatagtaactcgttatacacatatgtataaatatgtatgtgtatatatatataccaacatgaacttgaatttaaacttccacggttaccatcttagtggcatttggtatattgccacccctgttctgggccatggtcccttcactatcaaaagagtaaaaataaaaataaatgtgtatgtatttcttatcacgattaagtgggagaatatctgcaaggcactcagtgtagtataccacttttatttgaggtgtatcatatgacttgtattgattgcttaaagttttccactcatttaaaaaatttggaggctgagaaatgactgctgtttttactggtcgggattacttttttataaatcagcgtttttgaaatgtaattgttagaccatcaatgtactcattctaagtgtaaaattcaatttgcatcaatctggtttagttctggttcttggtagcctctcaaactattttgagggatgaataactcccccccaccacgttcattaaaatttgcaggatatttacagagttatatagccatcatagcgatctaattttggcacttttccaccaccttaaaaagaagtttcttctccatttacagtcatttttcactcccaccccagccctaggcaattgtcaatctatttctgtccatatgtatttgcctttttggatattttatatcaatataatacatgttcttttgtgtctggcttcttgcaatgagggtaatagttcagatccagccctattgtagcagatatcatggcttcattcggtaaacttgaatttttttattttttatttttatttttttttatttttattttgagacagagtcttgctctgtcgcccaggctggagtgcagtggcgcgatctcggctcactgcaagctccgcctcccggattcacgccattctcctgcctcagcctcccgagtagctgggactacaggcgcccccccaccacgcccggctaatttttttttgtatttttagtagagacggggtttcaccgtgttagccaggatggtctcgatctcctgacctcgtgatcctcctgcctcggcctcccaaagtgctgggattgcaggcatgagccactgcgcccggcttgaattttaacttgaattgtagattgctcttgctcagagtcaaatagtgagtagacacaaagagtacctattaaattcagcagccatgttgctctcctaattggcccccatatatttttattccaaattctctgaacaggcttaatgctacttcacaacagtaagcggggagaggggaagagaaagagcgggaattaatatgtgctggcaacaaagaatagctcataggagccttaagtgagcccaagttggccgattttcagcccgttccatatagtgatggtgtcaaatagaaccagcaagcaacataccgcatctctccccaaactgcttttcatatgttgctcagtacttctcaaaatatcttgaggaaggaacacttttcccctaatccattgtatgtaagatagaataaaaccaaagcgttacaaaaataagatgcccaacacccatgcttcctcctttattattaaatacattagacataaatggtactctgtaaaatcgctacataagtttcttgatgcactctgaattgttgactttatcttatggcatagtaacaaataattcctagagtgaatccagtttgcagatcccgctttgcgtaagacagatgtaagttttgacaaagccagcagaagaactcaagcatgcacagagctccaaaaggcactctgaactgtatttattgtttatactacttcttatatgatcttaccatttttaaaaatatcctgaagccctttccaactccatctgaactagtccaagataagctttcaagactattatgtctgataatttcttcacttgcttgcaagttgttcatttattattatttttttattttttatttttgagacagagtctcgctctgtcacccaggctggagtgcagtggcgcgatctctgctcactgcaagctccgcctcctgggttcatgccattctcttgcctcagcctcccaagtagctgggactacaggcgcccgccaccacgcccggctaattttttgtattttgttcagtagagatggggtttcaccgtgttagccaggatggtctcgatctcctgaccttgtgatccgcccgtctcggcctcccaaagtgtttggattacaggcgtgagccaccgcacccagcccatttttcattattagcatgtggaggcgcttttgcaatgaggaatatcagaaggaatgctttttaaatctttctttgtctgagacctctcttatagcctgttgtttttcatttatgcccttgaatcaccatatccttgagactgcaagactgtagactcttcccagcctctgcttacttatctcatctctcttatatcacactgccctgttctaaaactattaagcacactttgaaaaattatcttgctcagtgttcatcataatccagtgaatctaaaaatgtgtttttcttttttttttttttttttacaccaacattacatattttcttcctattaaatggtagaagcccttgaatttcagcaaagattaaaggacattttggtcaacttaatgtacattctagatctatcagataacgagcggcatttacagatagaaccatgttggcccctttttctaatgcaacatactatgttattaatagtgccatggaggacttctcattgaacttgtgaaaactcaggaatgcaaactctgttttcctattactgtttttctactgtccatctcaaataaaattgctagcctaaaacagtaacgcatattttgtaacataggcaggtttgaacaaaattgcaaagcatataacatgtgtttggcatctttttcttccttcttaagtgcaattctttttttttcggagtgctaaacttggctctggcaaccagctggttgtaataacaaatcttgctaacagtggtgagctatcagaagtcaggtccatacttttactggacaattcaagggatgtacttaatggcaacgctaattcactttagaatgttcatattattgatacaatttgcaattacaggagaatgatgacgttcgcactgctgaaagccatccctgtaaattcctgcctaccaagtcacttctgtgcaagacagttcttgctctgctcttctgcagagcttcacagaaactatccttaccatataagattattcctaccctcttcatttctattcctctgctgcaacttcttttaatcacagtctgggttctggggagtagacttcggagttgagtttggcaggcagcatgtttattaagccatgccctggaaaaaaaaaaaaaaaaaaaaacacctgtagaagggcagaggtgacaggagtggaaagaggaagaactagagctgtgacgtagaccctatgacacgcttattcaaaccccatagacaacttgcagctaggatgacccctcagagttgtctcaaatggggttaaaatggctgagtgtttatactctgccccttcatcagtcaatagtagtgggttgccctagagagggtgtgacattggctggcaggactctgcaactcaggtggtacctgagagaactaacaactagaagctgcctgaccacagctggagcaacaagcccttccttgaaggtcaatcttggtggtgcacctccatgtccatcatgccttcttggcccagttaactcctagtcatttttaaaaatcactgctcaaagacatttcaacttttttccttttaaaaattgatttatagttgtatgcgcgcacacacacaaatacatctgtttaaattgagcctcctttagagacagtgagacctgaggacgggacagttttctgtttacaggctcacctttggggaccagctcaatgattttttgataactgccttttatgtaggaaaaggagacatgattatcatacattgccctttattatttttttttgtctgagcaacatttgcacctaagtagaagcaataacagcgaggctgaggctgataagctgaattagtgacataatgatgctataaaggagttttggattgaatactttgttgtcctttaacgttatgcacatagagggcagactggccaagcatttcacaaatgaatcacattcatcattggaggattgcttgattattgcaaatccattaccaccattaagccactatctgctgattccaaccgtaatttagcacaggacacaaaatacacctcctgcagtcactgtacataaaggttgagcaatttataattttagaatatgagacaaattacgtaattatttgacctgtattcactgagtaactgactaaataagtaggtcaagaaggaattaggaaaacttggataatccactcctaaataataggcttagttatcaagggattgtgacagatacatgcaaagatttcatatctccgaatcgttactgtgtttacaaagcatcatctcaaatcttttaaaagtatgttaaaatgagatttagtagtatatcctaaaatttgcatttactttttaataaaaagatgactaacattggagatgttaaaatatgcatttaccccaaaggcatttgttaacttctatatggatgaaaaaataaaattgtcatatttagaatgcacaataaatattcatcatctgatcaaatgttgatagtatatgaaccttaaccttcccagaaggaaagtgcttagtggtacagactgatcacttttacatagatgtcttcttccagcatctcataaggggcttatatttaaaaagcagtctttaataaataataattctttaataaaagatgtagacagttttttctatgaagcgtcactgcattcatgaaacttagaaaaaatgcttagaatggatttctgcatcagatgactcagaagaattaaacttgataatctgttgaataacatctgcacatgcacgaagcctatgagacaatcaaatacatggaaaccaagtaatgaaaatagaaccaaggctacatatgtacacctcttagggataaatatttccttcctttgttgttttttttctttattttaggtaggcaaacatttctgtcttcttttcagttcagccaataaatatagcttgcgttaaatgatggtatgaaatcaggggttttatctgaccatattttgtactttgatcttacactaaccttgcatgtaagatacacagaaatgaggcctagaagaggttaagcaacttgtccaattaccacaattaatagcaaaggcaaaatttgaacatatactttaaaaaacaattatctatagtattcctcctatccaaaaagcgcttttatatcttaagtccttggttaacaataagtctaatgttttatacactgtcttctctagcttgttcattgaaagctagaaggtgagcaattctataaacagtaaatgttgggtctaatatggcagaatccaggagtaatagtgaacacattcagtaaatggtatggcatagataccaatgaatcagaatagactcctagcctttgagaatagacttaacttctggtagaatctattatgtctcattactaattggccctaaaatttctatttatcactgaagatcaaggacattcatatttaagtttgcatggttcttgctcaaggaatgcattttcttatgaaaatttatttccacatgtaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcaga

SEQ ID NO: 5619 - DNA, 108020 bp, human
ctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagaga

SEQ ID NO: 5620 - DNA, 104338 bp, human
tggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaat

SEQ ID NO: 5621 - DNA, 104081 bp, human
gaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctg

SEQ ID NO: 5622 - DNA, 107962 bp, human
gaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 5623 - DNA, 107962 bp, human; identical to SEQ ID NO: 5622

SEQ ID NO: 5624 - DNA, 1338345 bp, human; identical to SEQ ID NO: 3315

SEQ ID NO: 5625 - DNA, 1338345 bp, human; identical to SEQ ID NO: 3315

SEQ ID NO: 5626 - DNA, 1338345 bp, human; identical to SEQ ID NO: 3315

SEQ ID NO: 5627 - DNA, 1338345 bp, human; identical to SEQ ID NO: 3315

SEQ ID NO: 5628 - DNA, 1338345 bp, human; identical to SEQ ID NO: 3315

SEQ ID NO: 5629 - DNA, 103944 bp, human
cagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagt

SEQ ID NO: 5630 - DNA, 107917 bp, human
cgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaaccc

SEQ ID NO: 5631 - DNA, 92845 bp, human
cggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaa

SEQ ID NO: 5632 - DNA, 33450 bp, human
tcctcattggaagaagaagcatagtatagaagaaaggcaaacacaacacattcaacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcatgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcactacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacctttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttc

SEQ ID NO: 5633 - DNA, 31044 bp, human
cattcaacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcatgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcactacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacctttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatgg

SEQ ID NO: 5634 - DNA, 31071 bp, human
aacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcatgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcactacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacctttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcat

SEQ ID NO: 5635 - DNA, 43258 bp, human
ccaggcaagtttctcgtcttctgatgcttactgtttgggggactcgcggggagggggtcttccagcctgtgtctgtctgcctttgcttcctccctctggctctctccattggagacagaaagttagatttaaaaaacgcaacagagaatataaaatctatgctcagaccccagataaacaaaactctggggccatattcttaatttaccgggtaccttcacatgtccgaatgcggcgtttatggagctaggaatgttttatttgtttcgtgtatttccctcctctcccccattttcctccggtgtaattcttagaggtggggacaggagagccagagggcttagctgggatcctttgccagagtggcttcttcattctctgcgaggtagcagatgttttactgtagcctgagttgggatcttggaacaaccctctccagcccaggacatgccagcgcttaaggtaactgcagttgttgcatatctatctcgttatcactgactgaatcgaaatgttccggaggcacaattaatgtgaatgccagaatgttgaaacaattcattgaaggacactattgaatgttttattttcaaagtatcgtattccaggaaaattttagaagactattgctggttttattttctctattttcagatatgctccaaagcctattattcccttgcaagacaaccagtgaggacctattctgtttcttataaggatttaacagtgcaaaactacgtgttagtttctcctctaaggttagggacctccttctgttaacctcttttagaaaaatcattttggtggtggtggcggggagatgtttcccctttctctatcattaaatgcaaaatgtttctgtgactattaagtaaatactaattattgttatttttgcttaaaaggagcagaggagagcatctcccagaatgcatgaatttgtggttcatattgataactgattgctttaccatcaaattgtttggtttgatgcaatgttaacaagtggtcttaattcacaacacagaagtattctattccagaaaacaaccctgctgatatgcctgccacccccaccccaaaatgcacacacaaaaccatgtttttgtcttgctttgtgggagagaaaaatggatggggtatcttttctggcagttgattagtccccgatctttcttgaattgtcatttgttttataacctataattatagaaaagaaccctccttgaaataaaattaataaaaccttacatgtttagtcagatcacaggaataattttttagagttgagtggaagcttccatgatcctcttccaatgtcgtccccggggagccgttaagcttcccacttctctgataacataactcctctactctacatacctctatcttagctcttaccaccttatgattctaggtttacatatccatcttgcttagagtaataaaatttatttggaagcaagggtaatgccttattaatctttgtatccctggagcctagtaaagtaaggtctgttgaaaaaaaatgaatgaataaaataatttggcagtccagattaggtttaccattccttgaaatccacctgtgcattctttctcttcactcctaaaagataagtcatttaattcaatggtactcaaagtgtggatcctcagaatacactgtgttctaaataaatgagagttttctatatttgaaaaaatctatatattgttgtgaactttaatatttaattttttattttttattttttatttttttgctgaaagtaacagaaaagccaactaaacatggcttgtaatactacagaagtttagctgggcgcagtagcatgtgcctgtggtcccagctacacaggaggctgaggtgggaggatcccttgagcccaggattttaaagctgcagtgagctatgattgcaccactacattctagtttgggtgacagggtaagaccctgtctctaaagaaaaaaaaaaaaaacaaagaaaatagagaaggctgacagtaggtaataactggagttgatacagtgacccaacaatatcagggttctgagtcagtgtcttaccctcatggcttcaagatggctctaacagctcaagacactcggtcctaatcccatgttcaatgacaggaaacggggtggaaaaggtcagagtatttttcctcatgcaactttctcatcagagaaaaaatatccttccccaaatttatctaacagaatcctacttttatctcattggcaatatctggggcacatagctgcccttagtggcaaaggagactgggaaagtatccgttttttcagcttctatagtggaaaggcagccagggagaggcaggtaggtgatgtatttggggaactgaccagaaagtcttctagactgtcaagaaaataagtctttttgaacctgtgatcgtatcaatgttctggccaagtaaaatactaaatattaatcaatgtagcaaaagcacacatttagagcagatttcccctctccacatgggtatatggtattttaagggtgccaaatcacttttatggagtgtgctaacttttagagactgcaccttgcctgtgtgtgtgtgtgtgtaatctcatagggtttctattaagtatggatcaaaccctcaagttcctggaaaagagtaaatattcagtaaatagttgtcctttgagtggagtgttgagtttgggagcttcaaaacttcacagggacatgggaaaggatttagtgaggaaaaaaaactgatgagtggtttgctgccaatgccttggaaggctggtttacagcatctgaatgtctttaatttggatcctaggagcctggagggaaacttaacaagagggaaaagaagaacctagggagaggtagtggcactgacaacttggttcaacagattatctttggggaccttctctatacctgtactggggaagatgtactactgcccccctcccccacacacagttcaaaatggtccctagcacacacacacacactaaaacttaaaaagttgaagcatgaaaagagtgtatattattgcccgctttgatttaactttctcttttccagtagaatattctctcaaatacttacagaaggtagtttttggacatcatggtgggagatcagataagcaagtatcgagagattgaaatttaatgattacaattgtcttagatttctcatcaatgaaaagaatggagtagatcaagcttgtccaacctgtggcttgcaggccacatgcagcccatgacagctttgaatgtggctcaacacaaatttgtaaactttcttaaaacattatgagattttttttcaattttttttttttagctcatcagctatcattagtgttagtgtattttatgtgtggcccaagacaattcttcttccagtgtggcccaggtaatccaaaagactggacacccctggagtagattagcagtggtattcaaactttgttgcacattaaaaattacctggggaggtttttttgtttgtttgttttctgtttttatttttttttttgagatggagtctcactgttgttgcccaggctggagtgcaatggcgtgatctcagctcactgcaacctctgcctcccaggttcaagcgattctcctgccccagcctcccaagtagctgggattacaggcacctgccaccacacgcggctgatttttgtatttttagtagagacggggtttcaccatgttagccaggctggtctccaattcctgacctcaggtaatccacccgcctcagcctcccaaagtgctgggattacaagcctgattcatcatgcctggctggagaggtttttaaaatcaagatttatgagctgatcctcagaccacttaaattggaacctctgggaatggaacccaggtatcaatattttaaaaactccctagatgactccaacatgtgcctgagtttggaaactatattagtttgctagggctgccattcaaaggaccacagactgggtgatttaagcaacagaaatgtttcttctcacagttctggaggcaggaagtccaagatcaagggttggttgatcctgaggcctctctccttcacttgcacctgaccatcttccccctgtatctttactacagtcttttctctgtgaatgtctgtgtcctaatctcttcttataaggatgctggtcatatattgtgtcagggcctagtctaaagagctaattttaacttgattacctcatcaaaggccttatctccaaatagttatatttagagcccctgaaggctgggacttcaacatgtgaatttgggggagacacaattcagcccatgaaagaaaccattggacaagtacaacatttctcaaactttaatgtgcgcaccagtcacctggaggccttattaaaatttagattctaatccaataagtctaggtggggtctgagattctgcagttctaacaagcccctagtgatttcaatgttaccagtttacagatcatacttgaagtagcatggttctgtctagatgagtggttctcaaactttaatggacatcggaatcacctggagaaattgttaaaagcagattgttatgatccagccccagaatttctgattccataggtgtcggggtagagcccaagaatttgcctttctaacaagttcctggatgatgttgatgctgctggtgtagggatgatacattgcaaaccatgtatctctgacattttgagactttatggtattggatgagtcagggtcattacatacatcattgtatgtgaagtttgtaattctaattgctgatagcattactttttttttttttttttggacagagtctcactctgttgcccgggatagagtgcagcggcgccatctcagctcactacaacctctgcctcccaggttcaagtgattctcctgcctcagccttccgagtagctgggattacaggtgtctgccaccatacccagctaattttttaaaaaatatttttaggagagacgaggtttcagtatgttggccaggctggtcttgaactcctgacctcgagtgatctgcctgcctcggcctcccaaagtgctgggattacaggtgtgagctactgtgcccggccagcattacatttttctttttgccaagcataattactttttctgttaataggacgaaggatgagaaagtgggagaaaatgctgtattgggatttcttttaatctcatacaaatagaagtgaataaatacagaggctacacatcagcccattagtctctattcatgtttgttctccaatcatagagctattttgcagcttgctcttctagaagctcaaagctgattttatgagattggttgcatacttctcatatgcgatttttaaaggattaaccattctagagatttcatggggcattgcaaatttcccccctaaaacattaattttaaattatttctaatttaatcacacaattgtttctacacgagaccaacagtgagctacatcaaagagtatcccctccccaaaattattggatatgaagaaaatattttacctgacttcatagaattaaatcggtaaaattcacattttgttactgttattagaaaatttgatatatatatatgtgctatatataggtgatatatatacacacacatacatatacgtacatgtatattgtatacacacaggttatgattttctatttgcttaatttaaagcattttatgttattttaaattgttcttaaagctctatttatatctccatatgaaacagtgaaaatatttctattttaaacttaaaaaggtattcaacttgtaatccaataagtattttaaacaaagatgtaatcaggtttctagctgccccatttactctgggcctattatctaaagaatgggtcttgctaaagtatttcccttacaacttttccaaagttatgccagatgtatagggcttctattaagaatagatttactatgccataactgttttgagtttaccctcatagctttcccacatgttccacattcttggtgaatttttccagtaatgcacctcccagcactgtcaatgggaagaggttacctgtcatgtttctagcctgagcttctgaccaccagataacagaagcccaattgtggagatggatacaacaagcccaatgccgttaaagatctgaactgtataattaattctgtttctcctgacttcatgctcagcagtcagccttaggatgccacatgttcattgccttcagggtgagaataacctggtcagagtgtctggtctccctgacagttatatctcccattgtaaattactaagccgccactctagctttaaacacttatgagtgttgtgggtgtgagtcagcacccaacaccctcaaacctaataaatacagggacactgataaagatcagttatctgggggttggctcaaagctaggccctgatgctgatgactcatcgaagtgaattaataccagctagcatttattaagtattttctgcataccagccactgtgcaattttatttatattatcttatttttcctcataacaactttgtgaggtagtcatgttaatttccattttacaaataagaagactgatatatgtatattaaaaacctgctctaaatcaaatgactattgtggcagggactttgagttgccatgcaatatctattcccaccttctcccttagtggcagaataccagttttattactggtaatgatgtatctagcaaatagtttctatttcctggcatcccttgtatcaaggtgtgaacctatgactgagttccaccagtgagaggtaattgtgttgtgtggtacttctaggaagcctgcttaaagggatttgacttggctgggaggagggcccttttgtacctcccccttcttcctcctgctgttagtcttgaatgcaggcatgatgcctggagccatcttggaccatggagtgactgactggatgtaagctagcattaaagatgctggaacagaaaggtagaagaaatctgggcctgtggtggcaccatggagctactgtgccagctctaccacagagatctttgtctgctattgaaaccaattggcattctgtcagcagagatgaaaggtagagttggctattggtaggcagtggacagtgttttcatgctatataccaagtacctaatatttgatctgtgatagatacatgtgtttgagtttcatctctgccacttactagctatgtctattggacatcttttgtgcctcactgcacagccttatagcctaccatttaattaagccgttagtccattaaccagctttatgtgggtaaaaccagagagtgccttgccttagcctcacagcaaatatctcacttctcactccaggacttctttgatgtttcaacaggaaggcctgttggaacactcttgtacccacacatgtgtgttatggaatgtgagggagttaaaggcccaagagccaacccttgaccaatgtgagatgggaacctaagataaatagtccctcctccatccttggcctgataattctcaattgccttttaatagtgtttgtttccaagagattctcagagggtctaactaagtaggattacgccctagttgtttacagttgtgaccaactcaaaaatacactcccgtattggttttctctcttcttttcctttcctgaatttcctacttctattccctagtatcacttccccaaacaaactacctacattgaaactcttgtttcagcctctgtataaccttctgtgtaaccttgaagtaagctatgctgacaaaactttttagcacttgctgacatttttatgtcccttctatgatgaggcaaaatactatctttggtgtacaaagatgaaaatacatcatgagatctgataattccaactattgtatgaatgtggatcaataggaactcatactttattgataggagtacaaattggtaccattctggaaaagaaaatttagtactgtcttgtgaagttgaacattttgcataccctatgacctagcaactttatttctaggtatatcacctagacaaatactcctacatgtgaagcaggaactctccttaggaatggccatagcaacatggttcataatacaaaaattctgaaataatctaattgtccattgatggaaaaatgataaataaatttggtattaattattatttcaacagagtaaaaatgaattaaccatttctctatgcaagaacacagatgcatattattaacaaaatcaccaaaaacttcatgcagttgggtatcatttttataaagcccaaaaaaaagcaatactacacaacacattcttaggaatcatacacacatgatagatcctaaaacaaggtgaacccaaaattcagaatagtactggggagacagagatgggataaggtaggagcagatagtagaggtacgaacattgatgatgttctgggtcttgaatgcggtgatgggttcataaaggctcatttagtattactctttataacttatttaaattgatacagattcttttatatacatcagattttatgtaataatttaaagaaatgaaaccatcaccaacaaagatgctgtactaacaaaggacagcctcagtgaaaagcctcctctagccctcactctaaactaatggctctcagagtcaatgtttctcatcatgtaatgtgtttttttcttttgtgttgttaagtatattgtaatcaactagaatggcagggtacaagattccgtttttcttacggcccttcagggtcacatcctctagtatatttagaaaaacacagtttgttgtgtcctctctgcgcctgtgtccatttgcctgtgattcttctatatgtcctgaagctgcccattgctctttgctgtgcacaatccacctcttattttactgctgtctcagcacagcacacaggggctacgttcctccttgtttcgtgtgtgtgtgtgcgcgcgcatgcacgtgcacaggcgtgtgttgggtaaaatggtagtgagtagggaggcagttgacatgacctttttctttatacttccaaacctactccttgctttccttaacaatgccaccaaacaaagcagtaaaactgtaccagatttttgaattttgggccaggatttgtaatctttaaatcatttgtgccctggaacctttgatgaagtcggtgacctccttatcagaatggtggcttaaatacataaactcaaactcactggattacaaaggaagcaaattgtattgaaatacggttatcagaaattaaaagcaattgtgtggtatagtactctatgtactttttaattaagttattaagcaacaagatctaacggtggatctaatgacctaaattttaaagtagtaatgattttgaaacatattacatgatatctacaataactgtaatatgatatgaaaaatatctgtttctttagtgacagtcacgggtactgctaatactactgtggtttgttgcttacattcatacttgcaggaaatattaaatgtcagataaagattagtgaacataaggatgtcatttttttttcccatccaagttcatggactctttaaattctactgatatattcttgggggttcgtggaccccagattgagaaacttgctctaagcaaagcaaaggaaactacaacagatgtgggaaataattttaaactgaataccaaatattacctaacccacagcctacagagaaagcagttacctctaacctttcatggagggtaggagagccgtctcagtttccattcttacctcacagatctttttttttaaataataataatagctaccatttattgagcacctactctactgtgtgccataagaggactttacttttcaattttctgcagacaagtctccatacttccgttaggaactcctgcctccttctcaaaggatctgatcttgctcttggattcatcagtcttccttctccactaagagttgcccactttagaataactccctaatggctcccacacaacagcataaggtgggctttggcaagctgagtcttgtttcatttaagacctttacactgcagtgagctgtaatgagcggagcccacgcacccctcctaaccttccactaaaacacttactttcagggatagcacaatcttaatacataaggaaaaagaagcattttcctgacttctccataaattaaaagactgcttaagcatacaggaaagctagtactgtacacttattatgcagatcaggtatagttatttattcataccatagctgctttcaaatgggctcactactgagctatatagatcttgtgatggctgttttctgagctacacaaacacctggctccaagtttgaagtttctgtttgtatgagtctgattaggtgtttagatagtgctacttgtatcttctacaatacctactggttgaatgactgattgattttaattattttttcagaattagtaatggatttttaataaactttatttttagaacagttttggtttgcagaaaaattttgaagatagtagagagttacgtatacctatatccagtttaccctattaaaatcttacatcagtatggcacatttgctacagctgatgaagcaatattgatacatcatcattaactaaggctcatgttttattcagattttcggaatttttacctaatgtccttattctgttccaggatcccacgcagtcttcatgtctccttaggctccttttggctgtaacattttttcagattttctttgtttatgatgatcttgtcagttttaaagagtactggttggacatttcgtagaaagtccataactgggatttgtctgatattttttactgattagactggggttctgtatttttgggaggagtgccattctcataacatcatataaagggtatatactatcaacataacttatcattgttgatgttgaccttgatcacctggctgaagtagtgactgtcagatttctccaccataaagtcacatttttttctccctttccatactgcatgcccatatttaaggaatcaggaattatgttccacctccttgaaggtatttacaaaaattatttagaatttttctgccctttaagatttgtctcttccttccttcatttatgtgtttatttattcaataatttatttgtatttgtatggattcatggtaatgaatttttagctaaacagctccaatcttatttttggccagtggcatgaatttctgtcacaaactatggctagccctatagttcctaagcacagaaaagagtaaaaccaatagctacatacagaatttgtttcactattggtctattcatctatctctttccatttccttatctaattttttgtctaatttttcaccaaaagaataattcagtaacattaaaaaattcaaacataaaagagcacacagtgaaaattgctttccaccttttcatgtttttatatccctcttcagcggcaactcctgttaactgttactgatgtttttttcagacgttttcaatgcatttattagcaaatagctatcattctgcttctttatactctaaggaaaaaggccaggaaagggacagcagggcaacaaaaggaaataagaaaggggagggcaggagcaaaccaaagattatgaggttaatcatagaattcttaattcagttactacatttgcttggcaaacaattcacttttccaagatttttttctggtgtagttttcccactattgtgagtttcaacccctgatgatcaagcagtgtgggtatattacttaagttttttagttgaaaacaagtaaatcccctctgcccagtttaagcagaagagtttatttgaaggtattaggtggtatgatttttatggccccaattgtctccatccctaatcttgtcttttggacatgtgactttgtagtttctctcactaaggataatatctatatgtcccttgattctgaggttgactatgtgacttgctttggtgaaggagatgttagtggatatgaagcacatagaggcttgaaaaagcatgtgcacacttctacttctgtttttgttcctctgtcaacttcaggaagatgacaagagccaaagctagcctgctggaggatgagagacatgtggtacagagccaagtcatgaaagttacccaagctgaagctatcttggattgtctaacagccacttgatctccaggcatttaggcaagctgaattgcagctgactatagatatattagcaaacccagccaaaatcagccaaggccaggccatctgaactctgtagatttatgggataactaaatgcttatttttgtatgtcactgaaattatagggctgttgtgcatcattttatggcaacaaataactgaggatggtacttcaaggaatttctgggagaggcagagaacgtggtttggatgctacatggccagaagtaccagtaatcacactgcaggatgtttctagcaaacactttgcccctgctgcctcatggtgctcagcatctgtcattctggagaatagctattagaaccttcaccagtgctctccaaatgaactgaatgccttgaactcactgcttgaaagaatcactgacatccagcacaaagttcacattctcattccagtcatcccgtggatgcatctgactactagattataaaccacaattagaactctagctgcaagggagtctggaaagtgtgagtgagtgtgtgtgtgtgtgtgtgtgtgtttagctttctagcatctgcagtacaagaaggcctgctagaaggggtttggagaaagtgtgagtcattctccagtatcagccatggaggcatagacaaaagaactcaacttcccgatcccctgagtttcttctatctctgcatagagatggtcaaggtgttgacaggacttagaatcccgaggggaggacccctggaccctttgactactctacacagaacttgacatggcagttttagctctagaaaagcagtttcattctgatattaatgactaggggtactccttgtttttcctcccttggcatttggcaaagtgagtagccaggtgaaacaacactttattctaattacgttggacactataaacaaggagtttgacctcatttcacgttctctaaagctgagtaaaaggttatagtaaaaacacttagagaagtatattgtatattcttatatagggagaatataaaggaagaaagaaatctctgtctgccccatattcatatgccaattccctttgatctaagtatcctaaatacctaaaaggtgatcatattaggctgatacattgtaaactcacccttgctctttaaccctactcccaccacaagctagaatggttgtctgcagtgtctggtctgggacacatgtcattaactgattgatagaagacatttccacaaaacgaaaaggctttggatatagatgtatttatttgtaaagtgccacttgtaatattggccacatgaaacctttatttgttctcctctatttttcttctgaagaccttgttctagctaaatatttgctgaaacatttttgtaacctttttgtgttttaacttaataggcaaagccatgctgttgttgacactaaaagcacggaaaagaattacatttgggcagtattttaaggggtgcttttaaattaatctgggtgagaaattaagtatacctcgtatctgtatagataatatctgaatccttgactggttaccagtaaaagtaggagaaaatccactggaatatatatatgcttctgaagagcatatggtctgtgaacattcccaacagtggaacatgaccagagcatttactgggaggatcaaaagatattctgatgttgccaggatgctatttggcccatgtggatttgcgcattcaatcagtaggtttaatatcctttgtaatcaatgaaaaaatctgaataagaaataatagtccattcagctcacagggaatttgtgataaccactcattattattgttatttcctgaagtagtttaccttgtattttaccaaaaatatttgggacgaggtctgaaacttctgctcaccaaggtgccaaactggcatcaagacttcaggccatggaaaatctacctccacagatggagtcaaatctgtggaggtagcttttcctcctacacctctcactgcagctcccactactcctctccctgtagaatcgtctcctccagccaattggtagaactactggactctagtgatatcatatacatttctatattttttctgtaccctttgccatgcctagaggacctccctggctctctcttggcatctatgatctgcctggatgagatcaagataaaacttagccataaatccagaattcttgtggtttgctcagcctttgcccaccattctcttctctgaacttctaccatgtttatatctagcatctaggctagcccttctgtgcccccaatatgtctactcatagctaaaatgttagtttctggaggatagaccgatttgcaattctgtgtatccccattccctacatcagtgccatatggatacaataaatactcagttgatggaatatgatgcctagaacatctagcacaaaaaccacaatgtttaaggagcaaaattccttgcatttacctggagcttccttcacaggcccacctgactactgacttcattcttattcttaaaagggtcacatgatccctttcttacaaaggtcacatgattattttactgcttccctccagtaatagagaggaaagggctctgtattggtctttcatctcaattttctccttgtgctttctgtgcatgaggtgccaaagcagtgtggcccttgatctactcgcttgactgattctattgtttaatcgccacaacaaccctaagagtaagtgccattattattccaatttggagatatggaaactgtcatggagaagttaagtaacgtattatctcaagctattaactggaggagccaagattcaaaccaagacattacggctcccaggtctgtgctgttaactcctatatgaaactgtctttcctgatgcccaggtattccattagatgatccttgaaacctcagagtttcttgggtcagaaagtttaagtaaacggaagaaattacagatccgggaacctcttctgttattctcattgtgctaccaagaatcccacaacatcctcttggtggaagaaacaaatgattaggaatttagtatatgatattccctcaaggctgcaaaatacagtacttcagaattattcacatcattaagatcaaatctggtctataagtaaatgcagattcaggatgtgaattcacactaagtaaagtacagtggttggaattctgctattgccacttaccagttataatatgggtatgttactttacctcttttatctggcacttagtaaatactaaataagtattaactactatttctataccacaatatttccctgtttctctagccatctatgcttccttacaacaaagcacagtgtaaagctctttgcctccacctcattggattaaataaacaggtctgtaaatataagagggaacaataatagtgaaaaaattggatactcaagaagtctagatgatcagagtgactttgtttcttttgttaatgaaaggatgagttggacggaaaaggagtgagtcacactgacaacgaaatgctaccaatttaggatttgattcattattttatgaccgttgcttgtttcctgatgctattcattgcttattcattggaggaacaataatcccattttggcttttgtggttttatagctgagacatccactttgaagcacattagctacacctctccctctccctactacttcatcaccatctcaaacatcagaaaatcaaattttgaaaattgcccagaagtattgggtgtacaaaaacattggtttctcctttggaagttcttcctgtgagggtttaagcatggggattttatagaggagatgaacatcagggatatttgtggcaatgtcacttcccttctcttaaaatggtgttggatggagagcctccgaggtaaagattctcaaattgtctgcagttataatgtccaaatattcgggagaaaatcccatatggcaagcaataaaacaaaattattatgacttccagttgatgatccatttttaaagggatagtttgaagtaataaagtaagtaaatattagtctagggaaaatgtggatatactttatgaactatttaaatacaaactatcttttcattttgtgccatgacctgagactactcaatgaattttccatatgtatacatttgctcttacatgtgccttttggcaatgccctttattatccttgaaaacaaaggcaccactatagtataattcaaatgtgtctagttcttcagtccttagagattggtggaggggctgcattacctctccctttaatataaactaggaacatgattatttgagaatgttgggggtcactttcctctcccagtaagattgaggaaccctgggtatttttacgtgtgtcacaagcttaacgtgaattttctcttgtcccctcacttagtatcacatacataacagcttttctttcagtcacccctgcttcctagtaactggttctccatgatactactacctctctctgacccatttcatccccaaactgtggaaaacagcctctttctcaaaacccagctaacagaaagttgtcttgtttaaggcttgaggataataccagggatttacaatgcagaaaggaaatttaaaacttggtatcagatatattgtgctttccgtccattggccctgcccttttgcagggaggcacactgtctttactctccttatctcttggcctgcagccatgttgcagatgtccacttattcccctgctgtaagagtcattcttttcatatcctcaaatctttcttttcctctatgccagaagaagcaaaagctgtttacaaattgaccctgggcataacaaagacactgttctacattattctacagaatctgttcatggtttctccactagtttagtcttgagtgtgtagtaatctctcacctgcttggttacaaagatgcccttaagtagtgtttccaagaatgaaagaagtactgtttcatttattactctgaagagtaaaaatgactacaggttcaaaaagcatttttgatcctctagtccagtggtttacaaaggggaaatatgactatggaatctataacaaatataaactttatatatatataaagaatggcatacatatacgtatatatatatatctgtgtatatatatacaattctcagatatattctcaaaaggtttaactccaaaggttaaaggtcatggaactcatgtgcttagcagtaggaggggctccttgtgttagaaaaacatcactaccaacaacaacaattaagactttgcttcaaagaacactgaaacccacttagtcaatattgtgaatttcacctgcaaatcctgtttctaatttgatttaagtgcttatgatttaactctttattaattaccttggtagaagcaggtgacattcttagttaccataagacttttccctagtgtgttgttcaaaaaacattggtgttatttgaggaaagacttaatagttagtgacttaattctaagcttctgggtttatttcattcagttaagtatttaggcatatgtttaagaggttcccgccaaggttctgacactctaccagacaccgaagatgattcagacacagatgccactctcataaagcttatataacctcttggggaaaattgacacaatataaataaatacaaagtagaaagttctgcatgccctaaggtaagtctagataaaaagtaaatttacatcacttggtatgcaaggcagtataatttctctgactggcactttccagtagctacgtagggcatccagctttagcttcacgactttgaatcccatcagtcatgggttcaaatcctacctctgatacttaacgactatatggtcttgggttattcacttattttcactgaactttagtgtccccgtttatacagcaagcttactaatacttcagaggttgatgatgaggattaaatgagataacatatatagtatataaagtgtgtggcacatagtaggtacctggaaggtggcttctcttttcccattgctccataaactgaccaaatagatgtaaataccttaatgcgtgaatacttattgtatagcttatagaagaagtaagaagttacatcttccaatctgaaggcataaaaattttatgaaatacttgtaagttactttatcatgaagctttccctgactgccctatataaaatagcaagagtactcctaacctcttttttacttcatttttccctaccacatatctgaaatattacatatttattgtttctattaatttttgttgataaatattagttatacatataccccaaaagttgtacatgtacccaaaaggagtacatgtggtattttgatacctgtatacaatgtgtaatgatcaaatcagggtaattgggatatccatcacctaaactatttatcttttctttgtgttgggaacattacaaatcttctcttgctgttttgaaatacataataaactattgttaactagaatttccctactgtactatcaaatgctggaacttatttttttttatctaaatgtctgtttgtatcccttaagcaatctctcattccccctccccctacccttcccagcctctgataccaccattctaccttttatctccatgagattcacttttatagttcccatatatgtgtgaaaatatgtgctgtttgtcttctggcttatttcacttaacgtgatgactttcagttccattcatgttgatgtaaatgacagaatttcatttaaatttttaatcttttctaatctttttatggccaaatagtattctattgtgtatatataccacattttctttattcatttatccattgatggacacttgggttgattccataacttggccattgtggatagtgctgcaataaacatgggagtgcagatgtcgttttgatatacagatttcctttattttggaaatattaccaacactgggattgctggagcatatgatagttctatttttattgtttggaggaagctgtttactgttttctgtagcagctctgctagtttccattcccaccaacagtgtatggtgttccctttttctctgccagcattttaaaattactctttttaataatagccattctaactgggatgagattgtatctcattttggttttggttttaatttttttatttccataggtttttggggaacaggtggtatttggttacatgagtaggttctttagtggtgatttttgaggttttggttcacccatcagccaagcagtatgcactgaacccaatgtgtagtcttttatccctcacccccctcttccctttccctcaagtccccaaagtcaattatatcattcttatgcctttgcgtcctcataacttagctcctacttatgagtgagaacatatgatatttggttttccattcctgaattacttcacttagaataatagtctccagtttcatcgagttttctgtgaatgccattaattatttcctttttatggctgagtagtattccatcatatatatatgtaccacaatttctttatccactcgttgattgatgggcatttgggctggttccatatttttgcaattgtgaattgtgatgctataaacatacctgtgcatgtatctttttcgtataatgacttattttcctctgggtagatacccagtagtggatcaaatggtagctggatcaaatggtagttttacttttagtgcttagaggaatctccatactgttttggttttgatttgcacttccctgacgattagtgatgttgagcatttttcatatacctgtttgctatttgtatatctacttttgagaaacgtcttttcagatcatttgcccattttacaatacgattgttttttgatattgagttgtttaagttccttatgtattctagttattatttactttttttttttactggctgacccccctccccaatagaacatgtttcacaagagcaggggctttgtcattacactgctgtgttcctggagcctagaatagtgtttaaaatatagtcagtgtgctcaataaatattttttaaatgaatgattgcaggaattaagtaaaattttaatcaaataaaatttaggatttttctattggttttagtaataaatagaaaacttttgacaagtgaagtggtagtcactgctatattggatactgaggctttacaactgcatcatgtctgttagtaatggtcatctcttagctattttttaaaaaattttcatgtgggctaccagtctccagaatctctttctctccatgaactttatcattctctctcaaccgtgataatttatttctgtcaggggtatccatgatttcatattttaaatttctaatcttcgtttcttttttctctctgactcagtagtttgtgtgtgatagttgctctgtcatattttcaccagtaggtgccagtatttgatataacttatagagacagatctaccacttatggaggattgcctttccaggaaatgttctctctcttgtagataattcagaaagagcaaaccattctctctgcttgcagtaagcctgtattgaatcttctttacctacaaaaagatggcatgattggggggtgaacaaaaggctctgatagcattttttcacataaataaatgcaaatccatatggaatccttctgacggatatgtctacatactggaaaactttaaaagatgtatttcaatcaacctaaaagttaattatgccattccattcctcaaatattcaagaaagtcttccatgcatttgggctacacagcagcaaatccataatcatggttcccagcttgcatattagttttagtgttttgtttaaggctctctggttgggggaagagtttaatgtaagattaccttaaaccaaatcaagatactttcgagaacaaagggattcttatgagagactaaagcaggtaaacaaaggcagctccgactgataaaatacttgtttgaaggtgtgtggaggagatggtggtatgcaacttttaaaaactggcagggctaggtgtggtggctcactcctgtaatcccagaactttgggaggtcgaggcgggcggatcacaaggtcaggagatcaagaccatcctggccaacatagtgaagcctcgtctctactgaaaatacaaaaaaaaattagctgggtgtggtggtgcgcacctgtagtcccagctactcgggaggctggcaggagaattgctttaacccaggaggtggaggttgcagtgagccaagattgtaccattgcactccagcctgggtgacagaacaagactctgtctcaaaaacaaaacaaaacaaaacaaacaaaaaaactgacagaattcacagatactccttctgtcttatcgtgtacttgccctggattctactctatagcatcagtcaagccaccataacttttcttggaagtgaaaaaatggcctgaaaatatggctaatccccaagataactttaaaatactttcagaagtagtttcaaagaaaacacaatggaaatggtgaggttatacaggtctggctcaaaccttgtgtgagttgatatggaaaagaaaatttgattttattacttaaatattttacatgaattgcaaagaggaagtgaaggcattacatatatacctgtccagaatcattccctgatttcatgacatttccacatttgtatctacttgttcactgcccatgcatgggggctgtatcaagttttgggggtcctgcaccttatactatttaagtggttgccattaagaaaatggttacaaaataaatatctcacacattcaacctaactagtccccctttccagagaaggagctttctcatccattcactgcagtcccttacctaatacataccctcacaccgggggtcagcaagctactgctttgtgagccaagcctggatcaccacgtttttgtattagaacatagccacatccattcagttacagattgtctatgggtacctttgtcttacacttaccaagttgagtaactgccacagagaccacaaagccctgcaaagcctaaaatatttactctctggccaactacacaaactgtttaccaactcctgccttacacagtagctgtgggttctagccccacttctctctggatctacccaagagaatctaaaacaaccattcaccacatcataggattgtataagacatcaggttaatcaactggacaaaccctcgtgccttttgattttgtcttctaagaagtccaaaatcaaatttagtccttattataataactcatccctgattactggcacaattatttttccatttctcattaaattttattttttctttatcttagtccagtggtagtgactttttggtaagccatcttatttcttatccggaaggtggaatttaagtggtaagctaacatggtaaattattatcagtctgcctaattagtcatatgtgctttagaatatttaaagcaggactaaaagttgctatttttaaaaagctaccttggagtttgtgcttgtaactcccaaggtgaagacagaatttatcactgggatacctgagcttttgtgtacacaagaaaaataatattttaatgcatctcttagttatgcagaggcaaagcccagatcttacaatgcataaaaatgtaaaatgttgttttctttggagtaagactgcatctctggaggattattgtgctattaatgggcttttcacctgttttttcttccttaaagggagtgtgttgtaggcccaagagtttgagagagagcacaagacagaggtcactaatctgaggagataagggcttttcttctcagcaacaggatggcatgctgagtggctaaagaggaagggggtcaatatgagacctctgggaatgaataagacctgtgggctctagaaaactcagaacaggttttaaatctttccagattagtgtttaaattaccctctgtttaccacaaagcttcaataaagtttttaaaataatagcctactgtttattttgctttggtaaaagatgggcaaggctgtattatgctttgcatcaactattgttgagataagtagaagtgaagaaggtaccatgcagaggaaaacaaaagggaggggcagttacaaaatggataggggtggtctgaggaggattgaagaggtgatcctagcctgatctgagacaaatggccacctttgggaaacctcagaagcatttgaggaaattatttccttttgctaaatcaaaagagagatctcagaaagctggaatgccagagttgcttatgtaaagcactttgacaaatatgttattagatgactttagggttatgaatgagagacgtgaaaactataactgatttggttttcatccttctaaaaagaaaaaaatataataagaattcagaattcagtcaggctgcacagaggttaactgaaggaagttagctgaaaattaattggaattcggggtcgacttctagttaagtcaaatggaaccattaactttagggtaaaacctgaaaccaacaaagaccaatccctctcaaaaagatagagagtctcttgttttcatagcaaatgtataaaagggtaagggcacctattagggccttaccctagtagattctgtgtcctgacaacctgacccgtccgctgagatggtaaccctggtttaactagttggtaattccagtttgcttaagcattgagattgctatgttgagacagctggttatccttaaatattataatttacttttttattttaatagaaccccagatttttagctgggcacatgtgtgctcagaatcaagattatatttcctagccttctttatagccaagtttgaccatacgaatatgtttttgtcaaagggatataagaagtgatgtacaacatccagaagctatctctgaagagagaaaaagcctatctttattctttcccttttttcccttctttgtggctggagtatagataagatggctagaactggagtagtcatcattggcaatgaggtgacctatactagagcaacaagatagaaggagcctgggtccttgacatgatgaaactgccgtaccaatctgactgcctttctctagacttttacatcaggggaagtacatttttccttggtcagctacttttgcaggtgaatctcatcctgattaatttcgcacaaaatgctcagctcccttgaaatgaaaacattgtgtcttagttgttaagtttattttctacccatggaacatgaagaacaaacacagggtttgcatcagttatctctctctactataatgctgtgtaacaaccacaaaatctctgtgatgcaactcaaatttcctccatgtgtccctcatcctccagcaggatagcccaggtatggtctcatggcaatgatagaggaaaaagagaacaagtactttttcaagcctctagttgtctcatgtttgttaacatcacattttccaaaataagacatgtgcctggactcagaatcaaggggtaggaaaatatattgtctcttgataggaggaactgcagtcaattggcaaatggcatggatacagggaagggtaaagaatttacgtcattatttcaatcattctaaccttcatattaaagttttaaaaataagcttagaattaaattttgggataggttttcataataattgtaatactgtatccatttggtatttaatggttttgcaatatcagagagaatttggcatgttagagaatatgcaagacttagattatgattccaattccaaatgtaagattttgtcattgattttagtcttttgaatgatatttggaaagtgtgagataaatttactaagttagcaaacagtactgaaggcctaagagaagttcaggttcactaggtctcaagttgaatttttagattttctagcattaagttttgtgaaaatatcttatttggtactcttctgaaatgttagcccttctaaaaggctttccctgaccattcaataaaaagtgactatatcactttaccttctcttctatagagcatttatcagtatctggaatgataccatatacttgtttattacctactttacccactaaaatacagtctccacaaaggcaagcattttgttttgcttgctgctgtatccagaacacttataaaggagcttgatatatagtaggtgctccaaaatttgctgaatgactgaataaagctttggttttaggtcatggctttgaaatacttaaagagaaattttaatataataaatttatgaatgtaattcaaatcctgtaaattaattaactgaattataaacagggctaatagtttgaggagttcagtctgctcaatttgagttgactaaatattaattaaaggttttctagtcagtggctaatagtttaaggagttcagtctgctcaatttgagttgactaaatattaattaaaggttttctagtcagtcactgttaaaatttagtgtgtatagaaatagaataataggatttgcaaactggtcttaaagacttataggaaagctagcttgttaaatgttgttttagtaattgaatattatttttaaaagtaaattttaagaattaaaaaaataaagtaacaatactgattatttctgaattaaaaaactgtgcaaggacttaggaatcctcatactgtccacacgaagtctgtatgatgcacatatcgaggggcatggagcagtaaacagctgagtcccagagaaggagcgaggagacattatttactgggattgctgtcactgtggagaatgatgatggtgtaacacaggaaatgtaggggttggggtaaaatggagggggagccatctttactttaaagagatgggtaaaccttttcatgtcttcaaaactgaaattgacttctgtctctccaaaaaccccatgatgagtcaagacagagttgaggagagagaataaaggaatatttaggaggaattatggtagcattccttttataaatcaattgaaaaggagaacaaataaacaattttcaaaggcttaatgataaaggtacccactgagggtgttggaatagcagtaatggcagtcacaatgactctggttttcatcagagcagaatctcctgtttctggctttaattatctaccattttggctatattgtcacataacaaccacctcaaaaactagtggctaaaaataattattttattttgttcacaattttgtgggcaaagaatttgagaagggctcagcaggacaaatttctggttcagattgtatgagctagaaaagatgggactgcgaggttagcttccaagaagaatttttttacccacatgcctagtaccttagtgctctttgatctctcactctctacatgttgtatcattcttcagagcctctacgtgtagcttgagattctcacagcatgatggtctcggggtagttgcccttcttacaggatggctggcttccaagaggcagaaagtaggagttgccagggcagttatggcctacaagtggaactggagtagcattacttccactgactcagttggtcaaagcactcacaaggcctgcacagatttaaaggaggtggcgatatagactccactttttaatggtgcagtgtcaatgtcacattgagtgaaaatggcagagtaaggacctctgaaaattcactcctacataaaaataataagaacactgaaaaatggtcagaatcaacattttcagaactctggaaattaaccaaagggttgcgctaatctggggagcatttattcaagaacaatggctaaaactcattaagaactgcaaaaatttctggcattttaactttccatattcccatccccctctcttcagccccatggtagccttaaaaaaaccaatagcctacaatcagtgaaaaccagcatcctgacagccaccggaaagggtagaacagagttgaagcactctgcaacattccagagaattatcattatttgacctgtctgtggttccctgaaagatcactctcaaagctgtctttattttacctgacttggagcttgctcagtatgtaaagctttttcttcagagaatttgtcaaaaacaacagaggcaattgttgaaccttgaagctgcctgaggtggtacatagattgcaattgaggtagacaataggctaaacaaaaaacttaaatggaataactggaaaatgaaatgtccatgggggcttcaaaaattgtaacatgtttctggaaatctggagggccatgcacatatatagggctctttgcatgctcaagaaaaacctgagaagtctctaactttttatgtctgactaacctcaaggtgctctgcaaataggaagtaaaggctaagttggagttgtaaactctctgcctgagtgttgagggggtgcctcaacatgcactcagagaccctcaacaaagactaggagacttattggtttcagacatgtaaggaaatctcaatctaatcattagctaacagagtagagactccactggccacacatgacaagaaatacagatttcactgaattagtttagaaaagtcactaagcaatcaagaaaccctggggaggtaggagaaattgatttccagagttaccacattatattattttaaatgtccacttttaaattacgaggcatgcaaaagaacaagaaactatggcgtatccacaggaaaaatgagtcaatagaaactatctttgaggaagaccagttgctgaggttactgacttgaaatcagctattttataaagagctgaaggaaaccacatctaaagaactaaggaaaagcatagaacaatgtcttacaagtacagaacagaacatcaataaagagataaagtatttaaaaagaaacttgcaagttgaaaagttcaataactaaaataaaactttcagtcgaggtgttcaacagatttgggcaagcagaagaaagaattagtggacttgataatagactgattgagataatctaatctgaggagcagaaaaaaaaaagaaaaacatagcctaagagacctgtgggacaccagcaggcatactagcatattcataatgggagtcctaataggagaagagagagaaaagacagcagaaataatatttcttttttttttcttttttttttttgagatggagtcttgatctgttgcccaggctggagtgcagtggcacgatcttggcttatgcaacctctgcttcctgagttcaagtgattctcctgcctcaacctcccaagttgctgggactacaggcacccgccaccacaccctgttaatttttgtatttttagtagaggtggggtttcaccatgttggccaggctggtctcaaactcctgacctcaagtgatcagcctgccttggcctccctaagtgttgggattacaggcgtgagccacagcgcctggccgaatgcttcaaaataaaatggccaaaaacttcacaaattcaataaaagatatgaatctacacattcgagaatccctatgaattccaagttggataaactcaaagagatctacatttagacaaacaataatcaaactgtcatcatgaagagaaacctttgaaagcagcaatatcatcacagatcaggaatctccaataagattagcagcaggtttcttatcacaaaccaaggaggacagaaggcaaagtgttgatatatttgaagtgctaaaagaaagagactgtcaactaagacactaagacttctatatctatcaaaactatcattcaaaagtgaaggagaatttaaggcattccggataaataaaaacagacagaatttgtcactagcagacctgtccaacaggaaaaattagagagtctttcaggctaaaatgaaaggacaccaaactgctactcaaaaccatgtaaagaaataaagaacccaggtaaagataactacatagttaaacatatataaagtatagcataaatttattttttctttttaactgttttttctcctctttgatttaaaaggcaatttcataaggcaataattgtatgtctgtattgatgggcatgcaatgtttaatgctttaatttttatgacaatatctacacaaataagggtgcatagaatggagataaattggagcagtgttttttgtattatgttgtaattaaattggcatgaatttgagccagtttgttttaagttaagatgttaattgtcattgccagggcaactactaagaaaatatcttaaaaaaatacagtaaaagaaatgacaagagaattaaaaggtacaccagaaagtatctttttaacacaaaataaggcaataatggatgactaaaagaacaaaaaggcataaggcatataaaaaataaatttcaaaatggcagacacaaatcctgcttgacgagtaatcgcattaaatataagtgaattaaacagcataacggatttttaaaaatgatacaactgtatcctggccacaagagacatactttagattcaaagtcacaaatatgtcgaaagttaaaaatggaaaaagatataccatgcaaatagtaatcaaaagagagctggagaggctattctaatatcagacaaaatagactttaagacaaaattgttgctagagataaaggaatacatttaataataaacagtgtcaatccaacaagaagatatgaaaattataaacatatatgcacccacgaagagaacatcaaaacacatgaagcaaaaattgacagaaaaacgtatgtgatgggagatattgttgtggccatctttagaaaatataatctgccacatgcactagaaaaattacactatgtttagtattcacattatcttgttctagtaactctcatttagatatctgttatagaaattaatggactgattatccctcaaatctcaagatcatttattaagacttcacattagcatccagaggctgaggaggctgaggagttcatatgatacagctcatataattttaaaaagaaagtatccttttatctaggcttttcatcttttatatataagcctgccttcccctagaggtctagatataatgtattgatagccagctattgaggactgtaggtgattcactcacctccgacttctagaggcaaattcttatggtcaaccaggaagctgaggcttccttcattgaacatttagaatgcggttattcacccaacagttgatatagtccatgtcatactcataaattgttcccacaaggggacagtatatatcaaaacagactaggtgcagtggctcacgcctgtaatcccaacactttgggaggcagaggagagcagatcacctgaggttgggagttcgagaccagcctggccaacatggagaaaccctgtctctcttaaaaaaaaaaaaatacaaaaattagctgggcgtagtggcaagtgactgtaatctcaggtacttgggaggctgaggcaggagaattgcttgaacccgggaggcgaaggttgcagtgaaccgagatcatgccactgcactccagcctgggcaacagagcaagactgtctcaaaaaaaaaaaaaaaaagtacgttgacagatgtggtaggtacattttctagaaattctccccatgattccaggtcccaatccccaggacctgtgaaggtaattgggtatgaaatttgtgattgagtcttgactcatacattgagtcttgttacagctgtgttacttcataacacagttgtaaaggtaagctatcagggtatcgagtagcctaatctaaacacatgggcccttaaagtagagaattttctccaactgctggcagaagaagagggcagacgggaatgtcagagacattcaaaacgcaaggcggctttgattcaccaccattcctagctttgaagatgaaggggaccacatgaaaactgtggatggcctctacaagctgagggaggctgtcagctgccagtcagaaaaggaagggggacctcagtcctacaactgcaagaaatgaagtctgccaacaacttaaatgaactttaggttgaagcagattctcccccaaagcctcttgaaaagagctcagccagccaacatcttgtgaaactcagcagaaaatctagccacgtccacccagaattatggcctacacaactgtgaggtactaaatgagtgttcttacaaactgcttagtttatggtaatttgttacacatccatggcaaactaatacagtggatcaacagagtaccaatgtggaatccccattaattcttatctttcttcttcccatgatcacatgagtgagctacacagatgttgtatataaagcaaacatgaagatgtctatgacaagcgatgggcattgcaaattcagggatttccccaacacagacagaaagtctatggatttaatgattgttgcatatgtgatacaggttttattattgcttcaaaacattatgtttcattatggaagggggttgggctgtaatcctggctggaggatatatgaactaagaaaatattactacatagatgattgggggaatatgtgagaaatgaatacatgatatatgtgcacaatttcaactttatttttactgcagcagataatgataagatgtattttcactgagcctgcagaatttaaagggcttgtccagggagatttttgaatgtacaggtttggaaagttttcagaaaatgaatagagaaacttatctatggatgtcctttattgtccaatcttccgtcattgaaaataaccctttgtcaggcactggtgataactatcaaattgttagtcattctgtagccccactaaagtagaaaatctttctgctctcagatgctgcatctctctaatagtagcagcctaaccttgcaccttgacatgaatcaacttgtggctggctttaaaatacttaagcaaatgcttatttgcattgaatttttcatttctttatactatatctccttgttgttcataaagtcacatgctttaaaactttggtttgaatggaaaagaaacttaaagatacaaagagctgaggatgatccctaacccacaaaataagaattttccatctctgccattcattgtgtcattttgtcatattctctctctctgtctctctttctctctctcacccctcactcctttcctccttccttccctcttcagcctcctcccttgcccctgttttaaatatgtattcctatcccattgtaatgccaaaatgctttagactgagcacaaccctcacttgagctttttcccttttatcagctaagcttggaatttttcaaaggttagatatgattacttactgtgaaatactaagacagaccttctggcaattgttctttcatccaaatgaagggttgaactttcaaacagttcatttactaggtactgcacctattcaaatgagcctgcattaatacaaaaatttttgaaacaaagttgttgagattgtttgaaaaatggtcaggcgcggtggctcacacctgtaatcccagcactttgggaggccgaggcaggcagatcacctgaggtcgggagtttgagaccagactgaccaacatggagaaaccacgtctctactaaaaatacccaaaaaactagctgggcgtggtggcaggtgcttgtaatctcagctactcgggaggctgaggcaggagaatcacttgaacttggaaggcagaggttgcggtgagctgagatcgcaccattgcactccagcctaggcaacaagcaaaactccttctaaaaaaaaaagaaaaaaaaagaaaaaaaaagaaagataacccattccacaagaagaagatcagtttccttacaagcagattattgttttagtcacaaatttatacctaggcttaacttctttctatgttttagctttatctttattcttctatccttcctctgctgtgctggtgctgtggtagaaattatctagaggaagacctgtatagggcagcggcagggcctggcttaagatgagacctggagagtattgctaataattacaatgggaaatggaaaggctatcttagaatattttatgtgctattcattgtcatcctaggtgcactggctgagcgccatcaattatacacattaatgcaattagtcaagatacagaagcttgtattccaaatgaaaatttcctacatctgaggcatctgtgtaaaaggtaagatgtgctacatttccaaaactgtgtctaaaattctatttacaatgggttacgaactcaatacccctagaggcaaggcaggtagacaatgaggaaatggtgataactatgataaattgggtgtgtctgccctatctttttgtcttgttttgttttgagatagagtctccctctgttgcccaggctggagtgcagtggcgcaatcttggctcgctgcaaactctgcctgccaggttcaagcgattctcctgcctcagcctccttgaatagctgggactacaggcgtgcgccaccatgcccagctaatttttttttgtatttttagtagagatgaggtttcaccatgttggccaggcaggtctcgaactcttgacctaaggtgatccgcccgcctcagcctcctaaaatgctgggattataggtgtgagccacctcacctggctgtgtccaccctatcttaaggagagagccattctccaacctctgccttttgttgccacacagattctgagaccactgttgcctgatcctgattcttgaaagaggaagcagaaacatggattattttatttgaattcccctatatgtaaatgcttattcctttttcatacaaatgaaacataatagacaagacaaacaaaacactcctataggctggatttagccactggatcattaatatcaaggtgaccattaaaatcaagggttcccatgggagacggaacttgcagtgagccgagatcgcgccactgcactccagcctgggcgacagagcaagactccatctaaaaaaaaaaaaaaaaaatcaagggttcccagtgatctcgtttcccacattggttctctctcttttactaggtatacatgtttagtatacagacaagtattttcagttagggataggtgtgtatgtatatatatatatatatatatgtatataatttgtgcaaggatgttatcttttgcatgaaaatcaatctaggtgtatgaactgggcctgtaaaatttattggaagtcagtaataaataaatatgaccactgtgtttattttactgtcttctgattaaattttgtgttgactctggggtaaattatctgatatgctgcaatgggatatttccaggagacttatttggaaaacctgattagaacccagtagagggtaaatgacagagtccagtgaaagaaatcattcttggaggcagttgttttcactcttcatgactatttctagaaataagctttagggaaggatgttgcctaactagggcttactgtagagggattttcctgttcctactggcaatttatgtagttactatgaatcagtggtagaattagatgcatttgttgactgaatcaattggagtttctgtttgttttaaatcaggcatacaatatatcatgccttacaatgacaattaaatacagatttagaatcactggattattaaatgtaagtgtcataaggacaagtaaaatgcatcgacttcagggattccctgccagaaagtcatgcttactggattcattgcacagccgtatctgggacccgctccccaccacatccagcttgtgcagggacaatcccagaaagaaatgtaaagtggctgattacaattttggagtgtatttcctgagaccccttacccctttctgaccttgtaattcatcattgacgttaacataataatgatgattgaggtaataaagcctagatctttaacatatgaagttcagagaccatagcagaggctgctggtgccctaccatcccttccgtgttcacccggacatgcaaaaggctgcttgctgcaaaaacctgctactattactctctgtctgagggctttttttcccctgtggtcaaagaggcaagctctccttgtgtctaggataaggtccccagaagtagcctttaaccaatgactgatgggaagttgatggataaaaacaccccaacttctttgactgtcaaattatgtatctctaagacgtgactttgcatttccagcaagttcccatgtgatgcttatcctgctggccagggactacactgtgagagccactgtactaaagacattgaaccacatcaaggactgaagcattttaggatttgatcacgtgttcttttcatagaataattttctaaaatctatttttacttatgcctcctacccacggaagtcaattacttgaaataacttgtagggaaaaaaaaacttttcatttatattttatcttagccattcccttactgtgattttgattttcttgctgtcagggttaaccgttttggtaggcctaaactaccattaaaagtcgttagtggtataaattttctaataattcagaaaaattctattgtattatttgtgaatctaattgagttaatgagttttattctacaaataatatttataataataggtctttcataaacataagcacaaattctttcattagtacatttttcctgtatgtcaacattttaaataaagtacatatgtgaattttatggcattttttcatttgtgatcatatatttctttaagggaaatagcacatcacttcagattcctgttaattttacctgctgtcatctcctacttaaatgagtcatgtcaagtattacgtgctgcttctcctgacaagtacctgaaagttggagcaattttcacacactctgtcctattcttctgtcatagttcttcaatgcattatgggcaggaaatgactttgactgatgagaagagttagtgggaggatgttcaaatcaaatggcacttatccttgccctccacccccttatctctaagaactccccacagatggcttacgttgtcctgggctggtttatggtatagcaccattctctgctaagctcttgaacaccagctcatctgcttaattccaggtcttctctatccgttctgggctctcctatcctcttccccattgctgtgcttcacttctcccttttttcaaataaaactaacatatggcttttgtgtgtggccgatttctaaatcttggaaataacagggaagggaaaaaatggtgacaacccagcccagtaccacaaacttacaacagaatatcatgccaccatgttctcagttctttagctatgcccgatcacagagaatttctcctcaggcctccatattgcttatatctttgcctcttcctctttctgtcccctgctttcatcccttcctcccttcttgctggcctcccttctggccaccttagtctctcttactctgtttcatggtgtaatttggctctcattcatttaaaatttgagcaagggtcctcacatttctctatgaacaagtcagtcaaggcccatcatcaaagtatttttctaaacaaaagagctatctacctctgagaagatttgaatcattcccctagagaggatgaagtgaccatagtcagtattgttttaagtaccattttaaattctcactacatttgttaaagggaagacaatagggaggcttactgctgagagtatttttgtgaattgacacaggtttggaaaggaaaactaaggtgaattaggaagtgcattgctggcttatgttaaagaagaaaatgtttaaggactcttgctaaagatggtaatgaaggctttatttggggagactattggctataggtagaggaaccactgcaatgaggtcttgaaatgggggaaggagactgggcttaactctgactccaataaggccaagtggggatttacaaccaaggagcaggttgagggtcagtgggtggaaaattactaaaaggaaacctcagggtaagggtgactcttactagaccaactcaacataactcctgctgaaggctggccagggtgatttgatatcgaggatgggggatgagaaatttgattatacaaagtgtgggggattttcagtaaactaacttagccccattcttgcttatacttgattctacagggacaaagaggggagcccaaggtcggaactaggttaaaggagggagtctttgttacttagaagtcagattcctcgttttagctctgcttctgtctggcagtgtggtctttaacaagccacttaatgtctcccagcctgtgtttcatttgtaaatcgagagaatttgttctgtgtctttcaagctgaagcataagcctaaacaaaacaaacaaaaattcaccatggctcctgttgaagcaagggaggagtccagacctacccctttatttttttctctcccatggcctcatcggcagagttctgaacacactaatctagatgattttcataaacaattgttccctgcttttctggagctttttatcaaaattcagtttactataaatgctccttatatgtcaagcagaagcctctcaggtggaagcctgagaaaggaacttcccatggcctgacatagctgaggaattttggagcatagtcgtttcatgtttatttatggattgtttatggccctaggctaagctataaccaaatcttcttactcaccatcctatgtattcttaatatttaaaagtctatcacaggtctggtctgttttggaaatgatgtacctgttgaaaaagatttttttttttctgggaaaagagtctgggggcattttgattgagatttgacatttggcaataattgatgagtatgttttttatcttaaaatgcctgtgtaattgataatatacttaaagaaatctattacattagcaggtgattccatgaagaaggcagaaatcacttaaacctctatagcaggaatttgtgacataccacaaaactgccccaaccccttgggaacttgatttccattcacttgtggagatgagtcccctgcacttgccagacacccatgccaagtgggcagtggggcaaaaaatggagggtcattccatgaatgcgggcacaactgaaagtaagttaacacctccagagacaatccttagccaatggtgagtaggagtaggtagaataatgccccagccactcctacctttgatggtataattttgaagagcattgtgtgcagttcttcacagtatccttaaggagactgagtctcatttttctatagaagtagaatacatttgattttttcttcctttctctgtctcactttctctatctctcacttttgcatcctgggattacctcataaatacttatctgcctccaagtccttgcctcagggtctacttttgggggaacccaaattaaactaacttccaaagctggtacaacttcctatactaataattaaatagatggtcgactgatttcaaagcaaagcttttgcattctgcaactactcttaactttacatatatgttattgtttcaataaattgtactgtgttcttgagaatacaatctgaagcaaagcagagatataggtatagtaattctatttttacaagaattataaattgagataactgtgaattatatgattttagaatttaccttttcagctttcatggagcaagtttgttgagggtttttaattcagtaagaagaaaaatatgatgtggttttatttttttctgttaactgtcccccaactgtgtcaacacccctttcccaaagatttgatactaactttatgacatcttagtcagatttcatgactctcatcttactttgtattcctggaaataatcattttatttcagaaaattattttctcctcagtgggatgggagggaataatcagtctccatgaacagcgcccaaaagactggtgacttttccaccttctgcatagttctccagtcttgatgggaaagcagggtggtgttggttgatgataagggtgacactgtcctggcaccttccaatagacctgatctccactgttggtggctcactgaagactcaatgaacttagagcgtgtcttcaaattgggccttaaaattccatctgcatcctgttgtggtatgtttacttaatcttaacagtaaacaaatttgtacttcctgagttcgcatcagcaagtctgttgttagaagtcagtttgagttttagaaatttattaggtatgatttactcatgagtaaatgagagttggctaaaacaggtggaatgacaaaatcagaagcatcaaaaatcatggctacagtcaccttatgactatccagaattagaaggctctatgcagagatttgagaaatggcaacaaatgaaagtgccagcatctgtagttcagcatttgtagctgtggagtatgtagattcacttttacctgacagtcctctgcaagaaccattttaaaatgcttggaattgtatgttaataattatacaatgttctagattgcaacatggggatctgctattgttcatgaaaacttttatttcttgttctttttacctgggtttctatttcaatttataccttgcattaaaaagaataacattgaaaaatataaaccagagacataggaaaaccaacggaagtgctttaaattacttctctttaatcacttttgtatccagctgcttttatgtgtggaacctattattttacagagtatttcaatattctttatgattgaaaaagaatgacaaaatggtatatgcttttggtaaggtgctttggctatactacagtctttgatactacttggcactatttctaagcctgcatagattcttttaccacaaaaagaatatgtaaatagattcataaaattcatcatgagtttcaagctccatttggaatagaagctgaatatgcacatcctttggaaattctaattcttggaactggatttttcattggaatcatgcttttgtgttaccatgtaattaattcttctttggacatgggtgacaatttatttgatagaaactattgatgcccatcgtggttatgatattcctctcaaacctttaaatctcatccttttctatgctggttctcagcatcatgatttacaccacataaacttcatcagaaagtatgcttctacattttcatggtggaatacaatttttcgaacacactttcagtttaatgtttatagtgaaaatatgaagaagtttgagaaaaagctgaataaatatctcatataaacctttctgaagatatacattttcctgaattgaaactagtagctaacattgcttctggggagcagaaataagcatgtgtcttggttgctaagtgataaaaggaatattgataacctctaattatcttcctagtggagactttttctactttacacacagattccgtatatgtaggaatacatggataataagtatttcctgcaaaactggtcccctcttcatcacctcattgccttactctctctcttgccccactttcttctctccctcatttcctcctctccttaaactttcctctttcattcactgtcccttatttctccctcacttctgaggggccaaattgattgtcttcatattataaggctcacccttttcttgataatctctggtcaatcagcttcattcagtgattgctttgtgaacattcctgtgcatcataagacatttcctatttccatctgatatggtttggctctgtgtccctaccaaaatctcacctcaaattgtaatccccacgtgtcggaggagggacatggtgggaggtgattggatcatggcggaagtttccctcatgctgttctcgtgatattgagtgagttctcacaagaactgatggtttaaaaggatgtggctttctttgctctctctatctctcctgccaccatgtaagacatgccttgcttccccttcaccctctgccatgattgtaagtttcctgatgcctccccagccatgcggaactgtgagtcatgtaaacctctttcctttataaattacacagtctcaggtacttctttatagcagtgtgaaaatggactaatacaccatcagaaaactgatatcattttagctaagatttacatctttttgggcgctgtgttctggccactctttctctgttgggtaaaagaaatagaaactgcatagatttggcagacagactttggtgtagatcctaattttcccactttgtaagtttggctaagctagttatttttttccatattcagtttcctcacattaagtgaggctaataatagccaccttgaaggatttttgtgagattaaataagatgaactatttgattatttgttaacatcttaatttgaaaacattttctcctgtgcctccccaactccatttcatatttcttttcctgatgtttttatacatttccaaacaaaaccaaagtaccaaatgactcagtcaatttaagcccaaatacacagagttccaaatcttcttcatagcttcattgtttcagtatgagaatatttcttaagtgggcaaattctactccaggaggcttcagaatggtcaggaactttttttcttattttcttacacttatttcatttagatcctgcataattcctcccaagtttatcctattaccaagcagtctaatggacaataatgacagggaaccttatataacagagtagtaaaggttaatgacaacaagaggtataacatgagctgcttttatttactaggaatattagttgttctagaatttaaagtccaaaagcatcactggaatcaattttctaagcattagttttatgttttatttttaaaaataaaaaagcatatatcatttcaaggaatattattatatgttattataaaattatatattatattatgaaatcatttacataatttttgcttaaattattttttgcaactttattgaagtatagatgatggttagaatttatatatttacatatatttttatatatatttagagtatacaacttgatgatttgatatatgtatacattgccactttccccatctgccaccacctccccgcctcagcctctggtaactaccaagctactttctatgttcaactgttttagattccacatataagtgagatcatggatgtttgcctttctaggcctggcttatgtcacttaacataatgttctccaggttcctccatattgtcacaaatgacaggatttccttcttttttatggctgaatagtattccattttgtttatgtaccacattttttaaattcatccattgacagacacttagtttcgctattgtgaataatgctgcagtgaacataggaatacagatatctaagggggagagattttaaaacaaactgagcctcaatttgttgctatttcttttctgtatgtaaactctaaaggttcctattcaatttcagtcatgttatctgatatggtagccattcacattggaatctaaaaatcatttccaacccgtttcttctcttgtccacctctaccatggaggctgaaaaaacctgagactcactttcctattctcccctgccaatgagatataagggaagttattatggggcttcatggaaagtttgtactttctaataaaaggaacaaggtacataaatggcttgtctcagtctaatttctatgaattcctgcctttaaatgctactttgttattgtgatacttgcagctaggaagagcatcttgaaaccatgaagcaaccattcaaagaacaaaatcccatatgctaaggatggtcaaacataacagcagaaaaagcctatgtccttcatgacatgggtgagccaccaaaccaacctgacattgag

SEQ ID NO: 5636 - DNA, 58364 bp, human
gtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccggtgagttgcgcccgcgccggtggcggaaggccgggagggagggtccgcgggcggccgggccccgcctccggatcggccctgtagggggacaggccccaggcttggcagccggactggggcgggatcgctggttgcgctcccgcgaatgactgagggcagaggaccggacgggaagaacaggatgggggagaacgggaaagagggtgcctgtctttcgtatgctttttaaataagctcttgatgagcttcttgaaggcagggacactttttttttttttttatgagacggagtttcactcttgttgcccaggctggagtgcaatggcgcaatctcggctcaccgcaacctccgcatcccgggttcaggcgattctcctgccttagcctccgagtagctgcgattacaggcatgcgccaccacgcccggctaattttatatttttagtagagacggggttcctccatgttggtcaggctgatctcgaactcccgacctcaggtgatcagcccacctcggcctcccaaattgctgggattacagtcgtgagccaccgcgcccggccagggagggacactttctgtaaactccccaaagtgcggactccagacttgtgcactttggaggtcctgagctcccggttatgtattgaatgcagtaaagagtgagtgatcagggctgtggggtaaaaggggatacaggaaataaattggacaaagagggagaagagggaccctttagcgagtgttttttagccttttttttcctgagctccatagttagaaatacttttgacattgtgacccgatactccatatataccgtgtaacagaaatagatgtctggtgaagcagtccttgttctatccacttagattccacacacacctttttgataatgcattcttttaaaatgctgatcgtgatccactgaattgattttctggcccactaataggtcacgaccattttgaaaaaacactgggtttgagcagaatcataccttcactgaaatatgtatgttttcttccatgctcctggccggaactgacattcctggcctgcagttcacaatttagtgagacatacaggaaagtaaacaaaatgaccatataaattgacagtagatattacagggccagagcagagccaccaaaccttggcttgggatgagggtatcagggaagccaggggagccaagacaaaacagttaaaatgttaaagtaattcattctggggaaactcagagtctgttctagatcctagtctcccaactcaattattagttggaactgagatgcctcacagtggttctcaaaaagttgtccacagtggctagtctcttgcgtattaatatttattattaatacttatattcgctatgttttcctttctggtacgaattagtttatgtgtgatcacccaccttgggatttccccaaaagctggacctggcctactatttggtgtatgtgtgtgtttaaatggttattgggaaatggtaggggtttttagtctttcttcaaaatgacgctgtgccacaacagtttgtgaatactactcagatcaggtaatgacttgatgtaagaatgttaaaatctcaacatccccatgtactcctctcccaatctcctaggaccgtggcattttgtgatgatgttttggggggaaagataaaccgtcctttcccatgtactgtttctggaaagagaaaaagacatctctataactaactatagtgcatgagtaagatgagaattagaaacttcctgagtagctgtgttgagaggatcttttcattttataactggatccctaaacattctgaattctcagaaatcaggaaaagctaaagtgctcctttgttgacgacttggtaacctgtcttttatattaacaatgttgaaagttatatttgactacaaactctccattatgatgaattggtaaacaaaacattcaacagttacgaatatacatgtgtgtaagggggaccttttctgtgtgaaaagtagaacacacaagggctactttgtgctaggcaatatgggtagtgcataccctctgtaaccttagaaaatagttggaaaaaaacaacatttggggtaacaaatggtgaactctgtgtttcaacacagaaaagcagtgactttttttttttttttttttgagacggagtcacagtcacactgtcgcccaggcttgagtgcaatgatgctatcttggctcactgcaacctccgcctctggggttcatgcaattgtcctgcctcagccccccgagtagctgggattacaggcgcccaccaccacgcccggctaatttttgcatttttagtcgacacggggtttcaccacgttggccaggctggtctcgaactcctgacctcaaatgatccacctgcctcggcctcccaaagtgctgtgattacaggcgtgagccaccactcccggccgacatttttaaagtatagctttttattgctttgtgatgacctcatcttacatattgtgctacctaccaatctctctaatcaaactgttacacaaatcttgctgatttgtgtaacagtttgattagagagattgctaggtagcacaattatttgccatataaattctacagatcacgtagttcagagaagccagtgatcatttccaactcttatggtagaggaagagtttacagaggtagctattgagctaacactttgaggatgctaggctctgggctaagttctttatacatgtcatctcatttaatccttacaacaacctttgaatacctaattgcctttaaagcctatggttttttttctagctgctttcccttagttcgaatgaaagagatagtggtggagtaatttgtttctctctgtgctgtctccggttttatgggtattcattgggattaccaacagagaaattaagagttcaccattttggccgggtgtcatggttcacgcctgcaatcccagcacttagggaggccgaggcaggagcccaggagtttgagacctgagcctgagaccaggagtttgagaccagcctgaacaacatgctaaaacccagtctgtgcaaaaattacaaaatttagctggacatggtggcacacgcctatagtcctagctactccagaggctgaggcgggaggattgcttgggcccaggaggtcgaggcagcagttagccgtgattgtgccactgcgcttcaagctgggtgacagagtgagaccctgtctcaacaaaaataaaaagagttcaccatttgggctaacattgtttcccttacatgagaacactggaggttccttggaaaaactggaccaaagaaaatccaaattgactgatagagactctccccatggatagcctgatgatgttaatgaggaaacgaaatactgtcctgtttctgtgtgtggagaaaagctctcagtcagaggccagaccatgaggtgttaactagaacaagaatagcacagattgtgccatttcattccagggaatagacatctacttggtgacagcagaactattagtaatagatgactgccttccttgtgatagtatatttcttactttataccagtatatgagtaatacatgttcaatttagtagatttcatagataaaactagaatggagtctgaggaataagaaagactgaattaaggtggaagaaggaaggcttaaacattgccagagtgggggcaaagctgtcatgagacaaggggtttgtatggataaattactcaaaagttattttaataacaggcaacatagtaaaagttataaaataaagaccgtcttatatttgcagattcgggtgctgtgtttacatttgggaaaagtaaatttgctgaaaataatcccggtaaattctggtttaaaaatgatgtccctgtacatctttcatgtggagatgaacattctgctgttgttaccggttagtattacaatcctgaataaggacagtaatacttagaaaattctaaatattttgttatagatatgctgctgtgttttaaacatgttgaaaatattatcaaaagtgttgttttttactttgctggagaattcttcacaaaataagtcatcaagagcatcttttaaattttaagtttccttagtatatttaagtatgattttctatacacacaactttcttggaatgaatctatttcaatataattttttaaaaaaacctgttaccgtataattttagaaactcttttccacctaatagaaactggttatacatagatgaacaaggtaacttatttcaacacagaaaagcagtgacattttaaaagtatagctttttattgctttgtggtgacctcatcttacattatgtgaaaaatgcttcaattgattatttctttttccctcctaccaggaaataataaactttacatgtttggcagtaacaactggggtcagttaggattaggatcaaagtcagccatcagcaagccaacatgtgtcaaaggtttgggatctttttatcttttcacaaactgtataaagtatttttatgttgactgtgtagttctttaatgtcataaataataaagcttttagttctttattttctgacatttgcttgaatattattagcatttaacttatcttttatatgatattcagaactgcttttatatgttagggtctaaaaatcagattgattttaaatccagggaccacaaaggaagtaatgattttacagtattgcatttgaatatcccccatctttttttgtttgtttgttagtttgtaaaactacttacatattactgttattgtatatacagagaacaaacatatgttagaattttgagcttttctcatttaatacagttgtggacattatgcttctatttggttgctggttttataaaacatacttatcctgctttatatagtgactaggtgaagtaaacgaaacatcgagactagggattgattagtactagtgtaaaagaacaacaggacaaaatatttgaaatcaggagtgttccagaaaatattagatatataatacccttacaaagctttctggatgttatatgcaaaacctctgtttgggtataacctgtgaacatcagctaaacttgaaaggatgatggagattccttgagaagcaataagagcagtattttttatcttcctggctaaattttaatttcagctcaaaatttcagtgtagcttatcatattcatgctgtttatgggaattgttatggaacttttaaagtattccatgtgttcaaaaagtatttattgagcatagtctaaacacctgaggatagtcacagtgaccatgacccttactctcaaatatcttatctaatagacaagctaacaggattgtttagactatgggatccttgagaccagggattctatcttagtcatctttttgcagcccctatgccaagcacgtaggagatgttctttaaatgttttttgaatatgtagatgaatgaatgaacaactttgactgataggtgtatgcctatcaatattggtcttcggtttttcattgaatgtggtagaaggtgagcttgataatggtgatggcaggttaggtaatggatcagattggtgaggaggcagcataatagaatacagtgggtctcagcacatattaattacctgtgaagttgttgtttttttttttttgagacagggtcttgctctgtcacccaagctggagtgcagtggtgtgatctctgcttactgcagcctcgacctcctgggctccagccattctcccacctcagcaccccctccccgaatagctgcaactacaggcatgcatcaccacacccagctaatttttgtatttttttgtagagaaggggtttcaccatgttgcccaggttggtctggaactcctgagctcaagccatctgcctgtcctggcctcccaaagtgctggggagccaccacacccggcctacctgtggagtttataattatatatataaatgcctagccgctgcttcagacccactgactcagattccataggggtggggctaagatatctatattgtattcaaagctccacttgttatgatggtacacaaccagttctgaaaacctctggtttgctcgttaagaacattgactttggaatcagacaagcccgctattaaatctcggttctatcacttagttaccatttgtcctggactactgttcattttcattgctataaaataattgtcccattttaaatatttttagctctaaaacctgaaaaagtgaaattagctgcctgtggaaggaaccacaccctggtgtcaacaggtatagtgctcaacctgtatgatttcctgcctgactttgagaactgaggtctcattccagtaacgtggctttgtaaaattaatagagattatactttggcaacagtaaaattagggttttttaaaatgtcaatggctagtacacgtttgcctttgcaaatatacacgtaaatgtcaaatggctgaagaaaaagcttcttttcttggattctatcatgggacagcatctcctaacctgtgtgtccaccttaagggctggttattcctgttcttgctcttctctcttccttactaagggtgagtggaaggcacccagaaggctgttgatgtgagtgagcataattcccatcaaaatccatatgagcttttgtgtgtgtgtgtgtgtgtttgtagaaattaacaaagtgcttctgaaatttatatggaaaagcaaatgacgtagaagagccaaaacaattttgaaaaataacagaggactggcactacctggtttcaagactcgctgtaaagctactgtaatcaagactgaggtattggcaaaaagatagacaaagattaatgaaacagaatagagtctacaattagacccatatgtatatgcccacttgatttttggcaaagatgccaaggaaattcaatagagaaaggatagtatcttcagcaaatgctgctgtaacatttagacctccaggacctgaccactgagcagtacttcctaccaccttccccctgcccctgccccttgccccgcccctcccccaccaccacttattctgtcttcaggatgttttcactgcctcagctcctctccacctctccatacctttccctttctgaagtgtcttttctctttctcttagccttttaagattatttcttgagatcccattaagtgttaacttctttcatggaacattttgtgactgtgtgttcatttatttgtttgaattatttcagcatctcaccaactctggtttgctccatgtgtgtgaaattgtgcactccaattgcatgtgaccttgtattttccatttgaaagctagtcttgtttccccaattaggtttcgtcttttcctaaaaacaaaaaataaaaataacaataactttaaaatttttactaactcaggctgattttgccctcatttcaccttataatttagcaaggctttaacttcatttatatatttatgacataactaatttatgtgttacaaatcttcattaatttacaacttactggaaatgtttataatctaggcatgatgtactttttatttaattaacagagtaattaacaaacatttttacatactttaaatgagccaaatgctgttctaagaattttacaaatctcaactaattcaatcttcataacaactctatgaagtaggtactattattatcctcattttatagatgaggaaaatgaggcacacagaggttatggcttgcccaaggtcccacagctttggtaagtggtaagccagaatttgcacccaagcagtctggctctggagtctttcctgctaaacagagtgctatagtgccttcctatttagctaggaagttaaaataaatacaaagaattatcatgtttctaattagattcttcttggatttgccttgttttacttatttgtactattatatcttagctttaatggttacagaagttaaaattaatggacacatctcttttaaaatagatttgcattttaaactagtttggaagttactttccttgtttttactctgaattaataaagtgctatattagcaagaaataaatacgttccatgcattctgttcatttcagttgctagttacattctagattgatttctaaaatctcacaaaaatatgtggccttgcttgttttgctttattttgacgatgaaatgaagttgtctcccaaataataggatagtgatagctttcaactttcttcactgttaatagaggaaatcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactggtgagacttgtttctttttcagtctgggacacattcctttcctgtagatcaatatatgccaactcagtaaaccgaagggagcattgctgtttagttttctttcatcgactatctatgtgctttcagaaaacatttaaaatataactttaaatcttgacatactgcaattttatgcttatttatgcttattttatgcttatttgtgcttatttaaatatacatttaaaaagtaattggcaaataagctctaagctatgccgtctgtctactcctttagatattcttaaatattatttttgttgtgtgctcttaaagttatacttgcagttttaactgaagttgctgtcagaaacatccacagaaatctgttgcagcatatgttgttaaaatgtggtttgcaacggtcattgtacctctctgccctccctaccaaaagcccatatgagacatttctttaaaatttggagccaagatcagcttgatcttactgaagctgctggttagctgctttgtttcaagcaggagactgtgtaacatccggtgttactctatcaggaaagtcagagttgtctctgaggctcagtcctttagattttgtcagcccttaagttagcattttgacatccttctttcagttcttattttcatttatttgttttgcattattaaaatacttcaaaaatgtaaattatttaaaatatataaataaataagtcttaataattcctttctaaaatatttttcctagattaactttttctgacatcaaaacccttatcagaaattatatgttacctatttttgagatgctgtacatgctattgtatcttcattctctgaggctagattctgtgttttcaggtttaaattataaggaaaaaaaatgtagtgaaatacgtttcttctgttcttttttcaaaacatcatttccacagtgctcccaagagcaaggtcttccaggcttttttgacctgcaggtgtctaatgtgacctgtgctgtctttcagttcagttgcaggtaggctgcttggaaggaggagaacatttctgtttagaaacatcagaatgggaaagggtgattgtaggaaagggcattctgtctttgctatcgagataaaaatatggtcaggacttaagtgatttacaatcaggctgttctgtgttctttatcattatagaagcatttcacaatataaattgaactcttaagtagctagctggtgtaaatgtcttagtagtactttattgttaagatacataatttttatgaactaataaaataaatggtcttttggaagtataatagcttcagagcctggctaccttttaaaaccttttctcccccttttatttttctttatagaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgatatagtctctggttctatagaaataatgccatggttgtccatgtaatgaaattattttggtctgttttaggtcacagtatttccccatttatataataagagttcataatttcaaactctgtctgacatgatcactttttaggtgaatatagagagctcagcatgggatatagtttcctttggtgggactttctcagcattcccaacttctccctttcctggacccactggcaaccttttctgtcttagttaaaatattggaaatgttgggctctagctgttatagtctatatctatctacactagtaataatagaggaagtgtgattatgactttccatctaattgatgggatttttcaacagtaaaaacacctagaggaaatagtttatggaccctcttagacaaatctttaaatatttattttatacatttactctttattccatataccacaggctcagggttagaaagtggtaattcacccatttcactgccccctaaagttaccaatgaattggtagcagcatgataccaagagagagtaaacctgactttgtcagtatttttcaccactgcatccctggtgtcttgaacaaactgataatcaataaatattattgaatgagggagaaagtgaataaatgatgaattgattgcattccttgaggcaacactacctaccaacttattggcaacttttggctcctggggttggtatagtctgtactcgctttgttcatgaaacaaaaacacaaatgggaaaataagccaaccaaacaacaaaaataccaagtaaaagcattgtatcatatttgggctttaagaaaactgcctgaatgaattgtgtgaatgaactctgcattagccgttaggtgaacaagtggaatagttcatcttaaccaacaggcattacattgagcttttttttggtttgtttttatgcctttttttaattaaaaaaagctcagctttattgagatataattcacataccctacaattcacccatttaaggtgtacaatggaatgtcttttagcatattcacaggtttgtacataaaatgaacttttatactaagcattttgctgagattcatttacatcagctgatatgaactgtcagtaattttcacactagccattattttatgactttaatcacttaaagcaactttttataaattttggaaataactcaagtataaggggttttacttaatatgtatttcatgatagaggaaaatgttgtatagaaaagcattatttttttctctttgtatgttgaatttgtagatcagaaaaaatggattatttttaatttttaatatttgtgggtacataatatatatatagtgggtactacagatatatgtttagtgggtactctctctctctctctctctctatatatatatatatatatgtatatatatggaatacctgagatgtttttatgcaggcatgtgatgggcaataatcacatcatggagaatggggtatccatcccctcaagcatttatcctttgtgttataaacaatccaatgatactgtcttagttattttaaaatgtacaattattttgattgtaatcatcctgttgtgctatcaaatactagaaattattatttctaatttttggacccattaacctccctcctacacacaccccactaccctttctagcctttggtaacaatccttctactctttatttccatgagtttcttttgatttttacatcccacaaataagtgagaacacgcagtgtatgtctttctgtgcctgttttatttcatttaacgtaatgacttccagttccatccacgttattgcaaatgaccggatctcattctttttcatggctgaatagtactctattgtgcataagtaccacattttttcttgttttttgagacagagtcttgctctgttgcccaggctggagtacagtagtatagtcccggctcactgcaacctctgcctcccaggttcaagcgattctcttgcctcagcctcctgagtagctggaattacaggcgcccaccatcatgcccagctattttttttgtatttttaatagcgacagggtttcaccatgttggtcaggctggtcttgaacttctgacctcaggtaatctaccctccttggcctcccaaagtgctgggattacaggtgtgagccaccgcgtctggccccacattttctttattcagtcatctattgatgaacacttaggttgcttccaaatcttggctattgtgaacagtgctgcaacaaacatgggagtgcagatatctctttgatatactggtttctcttcttttgggtatatacccagcagtgggattgctggatcatatggtaactctgtttttagttttttgaggaacctccaaacagaatagtttatttcctaataaaaatacagaacatattactaagatagttatgtttaagacttcctacagatttttcacctactaatatgtttaaatgctcatgttcgtgttttaaattcatgttctcaattcaagttcatattataaattatataaaatattcaatttttagatcttatagataaataaaatctatggagttttcaggtattatccctgattgctgtgtcttttcatctgatatgttaatggttgggtctgagcattttaaccagtgattcactgaattaggtgtagtacaataggggatataagtaaatgagttggggttatgggaactgggggcaggaatttgtggagcaatcttcagatactggagaatagagacttggcagtgtgcttaagatcagaatcctggggaaggtagctgtcagagccaggtagagagtttgaggaatccagattttataaaaattaataggcctaagtgaagtagatataattgatatgaaatgacctatttattctttgtgataaatgttattttattttttatatataaataagaaaaataccttggaattaaataaaacattttatatggattaaaagcactcaccttcccctttaaggaaggtcctactgatagctacaggaaatatcttttctaaccctttacagcaagctcgtccaacccgcagcctaggatggcttagaatgccgcccatcacaaattgtaaaccttcttaaaacatgagatttatgcacagaccttttctttttttagctcatcagctatcgttagtattagtgtattttatgtgtgaccaaagacaattcttccagtgtggcccagggaagccaaaagattggacacccctgctttataggtaaaacattttactttaaaaagtcgacactgtgagaaacttcatcaacttactatgtaaaagtcattttaaatgatatttcttacaataccaagttgattaaaatgtagtacctacccttctgaagtttacagtcaaactataggatgtatagtttttccatgtacaaagcattttcaagtacgaatatatttcatttaatctcccaaccactctgggagagaggtggtggtatctgagattccatatatgcaggcaggtttagaacacagttttattcaaggtgatgctgcgattgagttgcagaatcagaattcgaactccagtcttccagttctaaaagcctgaacaatttctactgacatgcagtttctctccatatacaagaggaagaggaggatgtggtagcaactaataatgaccaggcactgattatgtgttctatgtgcctttgaatgcattaattcggttattcctatgaaacaaccctatcacataggcacttttatccccatgttacaggcccagtgattgaacaacttgctcagtatgactcagtaagtggcagaatccacatgcaaacaaggcagtctgactctgtagcacatactttttgctactgtgctagaccaataactgcaatatacagcagaccatgattggtaacgtaagacatttgatagcagagtcttacgtgagaacaagaaagaaaaaatattatttcttgttaggggcgtcaggacatatttcagagaaagggtggtatttgagattaaccatgaaagatggaaacaactctgagagagacagagatgagggaagaacaatccaggcagagacaaaaacatgtgcagagatatagagacagaaaagtaaatcatgtatttggagattattgcatagttgagtttgtttagaggttgtttgtttagaggttagggatcatggatcctaaaggaatgtaaacccctgaaatgatatgctaaatttggtaggtgcatttttttttttgagctaggtctcactctgttgcccaggctggagtgcagtggcataatcacggctcactgtagcctagaccttctgggctcaagtgatcctcccacctcattcctccgagtagctaggacaaagatgcgtgccaccacactcggctaatttttgtattctttgtagagactgggtttcaccatgttgcccagactggtttcaaactcctagactcaagccatccaccagcctcggcctcccaaactgctgggattacaggcatgagccatcacaccctgctgggatgtgtactttttttatagagctgtcatcaaattcccaagggaggatgtgactcaaaagagagtcaccaggttggggagtagatagaaatatgactggttagtagtccgggaacctaatatggaaggtctcttgtaacagtctgcagtttgtacttgatacatgtattttttttttatttggaagtgtcataattagagccttgtttttggaagatgcatctgatattgtgtgggtatgttagactagaggtaggaaagacatttggaaaacttgatccaggtgaaaattcatgttaaggtgtaaagggaatcaggaatctatagacagaaatggagagagactcatcaggacttaggaaccagtttcctatgggaggcaacaagcatgggaaaatggaagggtgctaacttactgggcaccacttttgtgccagtgtttgctaaatacttcatagaaaactgtggtccataaaacttcattttctgtgcagatcaattcagaaaatcaatatagctgtgtttacagtatttgagcaagttctaagtggtgcatatcttgtgcattggctgtcccacaccttcctgaagttctgtgattttctagaaggactcacagtcttcaatagcgattatacttacgaataagatttattacagcaaaggatacaaagcaaaaagaaaaagtgggaaaaagataagcatctgcagtggagtccagagaagtcaagcttgggcttcctagtactttctcttaggaaaccacacagggcatgttttcttagcagtgaactacagggacatgtgtggaatgtctctgcccagggaagcccattctgttgcttctaggggatttagggggctggtcatgtaggcacctcctgctagcaactggccacagcagctgaaactcaggaccctcaataatgaagccaggtgcacatcatcaatgttgatgtttgtgcaagcagccctgacaaacctaatctggcatagttcattgctctggtatatataacaaaatcattaatcattcacataaagaacactccaggggccaccttctcaggggttgggcaaggatcaatcatggttctctcagagacttgcaaagaataagcaagcagatctgctctgttgtctctttgcttataccaatggtgatatgttccatgtcattcttcagattggatcatatacttacacaaggtttttaaattctactttatagaactcagttaattgcatagaaatgaataagaaagttcttgctttcaagaagttcacagtcataatacagtgtgataaatgtaataaagaagcaaattaatagcgttagtatggacagggcagtgattaagtgtcaggaactccttggtaagagtctttggaggaagtgccatctaaatgggtaaaatctgctatcttaagatttacttaacatatttactgcacacataagtgagttttctaaaaccagtttcatataaagcaattattcattcatttattccacaaatattaagtgcttgttctagacactgctaggttttggggataccatagggagcaagacaaaattcatgtttttatgggagctttaagtaagtaaaagacacaagatattcttcacttttgtgaaagcactaaagtaattttctagttgtttattagtagtggtagtcatgaatttttcatgaaaatgattggattaaaataatcaaggggaaaagaaaatctagctttatttctttatcatacagtaaaaatatctcaagaaaggtcaaatgtattaagtgatccttgtcaaaacttttttttgacggtaagaccagctttttgttcatatgtatgtcatcactaatcactatacttttccttcaatagcagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacgggtatgtgtggagtccactgttctgttccctgcgttctgtggtggctaatgaaatttttttaatgttcattttttttatgttcatttttttattgtggtaagaatactatgagaactaccttcttaatagatttttaagagtataataaagtatttttatgtataggcacgaccattgtacagcagatctctgaaacttatcttgagtaactgaaacttcacgcccactgtacggcaactcgtctttccggcctcccctcaattcctggcgaccaccattttattattagcctctatgagtttgactcttagatacctcgtgtcaggtggcctttgcatctctttccattaagattctcactttttggacctggtgcaatggctgacacctgtaatcctagcattttgggaggccaggagatctcttgagcccaggagttcgagaccagcctgagcaacatgacgaaaccccatctttactaatattagccaggtgtggtctcaggtattcaggaggctgaggtgggaggatcacctgagccaggggaggttgagcttgaggtgagctgtgattgtcccactgcactcaagcctgggcaacagagcaagacctcgtctcaaaacaaaaagaaaaacaaacaaaaaaaagattctcaccctttattcctgtacttaatatacatttctggtctatggaatattttttttaagtagaaaaaaaatgaatcttgttgaattgtttctgctaacataatttacattttcatgaccttaactgtttttttttgagacggagtttcgctcttgtcatgtaggctgcagtgcaatggcctgatcttggctcactgcagcctctgcctcctgagttcaagcgattctcctgcctcagcctcctgagtagctgggattacaggtgcccactaccatgcccagctaatttttgtatttttagtagtgatggggtttcgccatgttggcaaggctggtctcaaactcctgacctcaggtgattcaccagcctcggcctcccaaagtgctgggattacaggcgtgagccaccacacctggcctgaccttaacatttttaatggcaacatattacattatttttagctcattttcagggacaaacaatttttctcatgtatatgttttctatatttatctaaaattgacatttttcctgaaatgccttcttttggagaagctttttgttcaagctattttctatatgtcattgataattcttttctttgtgacatttacaatgtgtagcttggggatttctttgtagttgtatgttctgttatagtaattcattaaaaagtggtatggttttaaattacagataataaaagaaagttaggaccttaatgttacttttgggatctgaatttcatatttgttatgacatgtcatttctcaggattctaatcactgtattgaaatatactcactacttgctaatatgtttactaaattgatgcttccaaattttttcaacattagatttattttagatgagtaatgtacataatacaattaggtagtgaattattattatattttttgcacaaaaaaattaacagtttgtgaagtcaccacttaatctttagtagcccaaagttagaaatgttgtagacaaattttgaataatatccaattctaagatgatatgcctaatgttgccaggtaagtgaataatattttatctttatgtttttttctctgatgttacttttcctcagcttcctgttctagccccagtcgtggttattaagctttagtttctagatggaatcttttctaagttagaaataattttttttcaaaacttatactctaaatttggaaataattctgaggtttaagatgtttttgaattcctgctgaaaaagtgaattttatataatttcgaaaatattctaaaaattaaactttgaaattaatttttacacattatctgaaaattcattctataggcagaaatgcaactttatgtgttatatattttctctagtttatacaaagactatagaaagaattaatttaataggtcattcagggttattttaacagatacaaatgttgattgtataatagtgtctttaaccattcattataaaacatttttctataaagagcaacaagataatctatgatacttttaatgaaagctcaattcttaattttaaattcttaatttaaaataaatgcacttaaggatgatattttcgtgtggttttaaagacatttaactttctgtggactttgttctgagcttaagtataatgtttccagaaattgattgctctctccagatttttgcaagcttacggatctcacacaccagtaaagttttttaaattatgagatgcatctatttgacagacctggaacagttattttttgccactaagatttctactacagatgcaagaaagaagtgtccttgcatttcctttctgattgtggcagccaacattgaatgggggaatacaggagaaaaacttggtaatacagggaaaaaaacatggagagataatttttacagttcataaataactttgtaaacagtgaagagcttgtgttacaatccagagaataatctaaaatttgagtttaaaaaattatgagaaccaatagatggttgtcagcttctgattcacgtttgcttaaatatgggcattgaaaaacatgactgcactatcatatcataaaataaggaacattttcaaaataaaaaactcttaattgtatataataaagggcacctccttaaactgtataaatgtatatgtatgaaaatttcactactttgcctgtttttcacatttctccatggacctgtgagagctttattatgagccagccctggtgaggaacctggttctggagcacagtataggcagaattttaaaaatatttagtcctagctgatgaagaaatggacctgaagagtatattgatcatcagtgtgactaaatactaaactggattgctaagagagttatggaatattttgtaagaccttaaggaaagaatagctaatcacctgttccaatttctttcactaaagaaaagcacttggattaggtgtttctgtgaaggaccttcccagccttgtttttcaaaagtctataactcttatcttaaaaatctattagaggatcattcattaaactattttaaaaacaatttagttcatttctgatgaatttatttaaaacataatatttgcacatgaccgtgatagattagaaaataaaactggttgtagtgatagggtgattatagtttctccttgggatcagggaaaccatggaccactgtggaaaaagtctgaggctggaacttgggacacactaagtgaggcagagtgatatttgtagttttgtaaatcgtccacagcagttaccaacacacaagaaaggccagttgtgagatggggttcacaatgaagtctgggtcctgaggcaaatgagaatttatcttaacttctcagattatgtttggataaacctaagttttctacaggttaacaaattattagttctgaaatcaaatatattctgtgaaattacagtaatattaatctgaagctaactgatcaaatctattttcctaatgtaatattatttattaacattaaattatgttgttaaatgtcacaaaggtgatatggccaaaaattctattggttgttaaatataatgtccttaaataagagcgccttcaatcatttttataaaatagaaactgctgtcatcactaatatccaagcacctgaatgggaacctaccaggatactgaacaaaacttctgtaacatgattcagactgcctaaacagcctcatttcacaggctaattaaaatcagacagcctaagaaatgtagagtaattgttggtcagctagagatagataattgctttaatttacccaatattctactgttaagctgaacatttagaactggaaatatgccatgtgattattatttaaactaagatggttttttaatattaaaataaagatctgttttgccattgcctcaatatggcttcatatctttgatacagcatattttcttaaaggagtagtatctatatgtcttatttatgaagcaaacatttttattagaaaaaattgtaaaaccacatgacaatagacagttatgttttcatttgtaacccccattgatagaatgagttgattagatactttttagaaaaatgttctttacaacagtatgtcatattatgttttcaaatctgcctgaatgttttctcttttaatcctgtcagcacctctgttagatagggattataacatcagagaatctaagtaactcacctgcttgccacagctagtaataatgaatgtttgggttctggcctgaataacaagctcttgcccttcctgctgtaataggagaaactcaatgtactaaactcaaagtacaaaactcagtgtactaaggagaagtgactaatataatcgacactgcgcttcctaatgcagcagccaggagcatgatgtctctaaaaggaccctttcatcaccactcatgtatcctgtttttgtactttttcatttctagaaaacatatgacgtagtatttactgagttactggaagtcctttggaatcacttcaaaatatcaatataaagaaaagcttttcccctcctattatagttgcatttcctagtgaagaagctttacttgtgaataaatctagcatatgccctatcagttttaattctcaagacaattctctgaaattgggttttataagatagattattaaactacttttattttattttattttattttattttattttattttattttattttatttttgagatggagtcttgctctgttgcccaggctggagtgcagtggcgtgatcttggctcactgcaacctccacctcctgggttcaagcgattctcctgcctcagcctccctagtagctgggattacaggtgtacgccaccatgcctggctaatttttgtatttttagtagagacagggtttcaccacgttggccagactcttctccaactcctgaccttaggtgatgcataaactgcttttaaaaggaagaagtttttctgtaggagacactattcacttttttatttgacgtagtgagttagcttaatgacagttggttcttttttattttttgagatggagtgtcgctctgtcacccaggctggagtgcagtggtgcaatcttggcccactgcaacctctgccacctgggttcaagcgattcttgtgcctcagcctccctatgtagctggaattacagatgcatgccatcatgctcaactaatttttgtaattttagtagagatggggtttcaccatgttggccaggccagtctcaaacctggcctcaagcagtccacccgcctcgtcctcccaaagtgctgggattacaggtgtgagccgttgcgaccggccaacagttggtactttttgagccgacgtaattatggggacatttcaggtagttccctgacttatgtgccttgtatcatacctgttacttacctaactatggttatgtataaaagataaaatcatacccatgtcataatttttataatgatgtaccttttcatttttctcttccttcatcattgaaagatttatacttcaatattaagtattcttaaatgtttttttttccccagaggcacttaaccttcactataaaaggttgaacgtgacagtttttccagatatgatggtaacagtgtctgcttccataatccttgtcttgtatttgcccctttcctttcagagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacaggtatggattagaatttctgttatatatttatagaactgggtatattttattacaaaataaattatatgtgaaatgaatgtatctaacttaagtaaaggaattaatggctgagaaaaatggaattccatgtttactattccaaagtataaagttgtgaactttttattattttaattcaatttagaataaatgtaaatgatccaaagatttagaacctcacaataggccgatgatgtcagaagttagaccatagtattattctttgtcagaaaacaggaatctttttgaaattatatcattttgaaggctcttaattctactcaggccaaaaggaaaaatcccacaagcaaaaacttattttaaaacattcttcctattcagtctgacagagctgcattcaggccgagtcagttgttatgtttttgccacctggaggcgttttcaggaatgactcctttccttctctttctacgtgttagagagaagggaccctcagagaccactaagtggataccttcttccactctgtggtatctccttcatgcagggaaatgttcctttgagcccacttctcagcctcaaaactatgtgctgctaataatataggactcagtaaagattctcccctaaatgattcagtcacatatatgtaggtaattgatatagtccacagttttcaatgctttgtgacaaacgggtatataatttcactatttctgtctaaatatgaagtgaagcattggaaagtcagaaatcatctagtgtattgacgtaatccatgtactagtatttctactttttttccttctttttgaaaaagctactgctatgaaaaagctcctgaaaaaactactgctcatctaatggtatctggctagggaaactaggaatcagcaaatgcaagatatactgtttcttcttccccaaagaagctttcagagaagatgacctgcccatgatcaagtatcagtgttcttgagaatgtatcatgaaatagcattatatagaatatgaaaagtattattcattcatcatccactaagagttgttgtgtatcccttaactatagggtcctaatgtcactttatctgtccttactgtcatttttcatcaactctaatcttccactaatagtagatacatactatttttaatctgtcatctaacatacaattcgaatatttagttaaattttcatagtacctttactcctgataaaaagagttatagcacaaataattgaacattaactttgtttgcctttttgttcatcaatcgtccctggagggcaagtggtgtggaattttttttttttttcctccaggactaatgagaagtatgtagtgggttatctgcaagctcttgccagttccccattatagccagtggctcatatttttaaaagctctctgaggttgaaagtgccatcaggcagcttggatcagggtttatattttcaggcaaaagacaatcaaatttaaaaggcaaaccttaaaaaacatttgggtaaagaaatcaggttgaaaagaaggaggaagaagggataaaggtgataaggagcagatataaaagaaggacataaatacttaatagtaagaattgtaagagtctacagcttggtcaacatggtgaaaccccatctctactatattcaaaaattagccagcatggcagcgcgtgcctgtaatatcagctattgaggaggctgaggcaggagaatcacttgaacccgggaggcagaggttgcagtgagctgagatcgcaccactgcactccagcctgggtgacagagcgagaccccatctcaaaaaaaaaaagaaaaaaaaaaaaaggtagtctaaagagtccaaacactgaatagcacttacttacatatttacagggaatctacttatttttgtaaatcgatttttatacttgccaccttactgaattatattattctttctgatgatttttcagttctcttggatttgcttagtatgcagtcactttgccgtcttaaaccagaagtccccaaaggtgacccagttgtttcccagcttaaaaccattcattttccttctaaatgtccttaagataaaacttcaaaaatccttcatctgaactaataggacactctgtgtagtcccttttcacctcttcagactcatctcctaccactctccccttagtgcttcaggggtattagttgcctttcagcttcttgcccgagccacgtttgctcttgattcagaggctttctatgtactgctgactctgcctggaagattctttgctcccttcttcatgcagctaagccctactcatcctttaggtttccctttgaaagccttccctaatccccagactagaggaaaattcccctcctttgaaccatattaacaccccttacttctgcttccctggcacttaccccagttgagatggagcggcttgaagaaaggagtgtgaaggttcgtaatagctgctatggcagtaagcaaaaggactaactggcgagaagtgacaagattactcatcatcattgtgggcccagtttcagaggggacccaggttttggtataggaattagttagcatttttggcttatggcatttacttcaacagtattccacagcccaggagccagattagttaagctaagccagtagtagagattttgtgcatcccccactccccaagtcacatgacaacgtttggagacattttttaatggtcatgactgcagaatggagttgtcctactggcatttagtgggtggaggccaaggatgctgctgaacatcctacagtgcacaggacagacccacacgaccatgaattatctggccccaaatgtcaataatgccaaggttgagaaactctgatctatcagtgacctcagggaaaaggaaaatagactgtgttgggatgtaggggtcagaatacaagcatctccttctccttcccttggaatatatgatgtgtatctcaaattctcattctgtattgctgctgctccacacactgccttgcgtgacaggtcatcaacttcacaaaccaccaaggttaattgatttattctcagaatatttattgcctgatgttacatgcaggaccacagagaccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttcctttttgctgaaatcttgtctcttctgcttcattctcatatatctgttgaaagctgggactgtgccatgcccgcaggctttgtatcttgtgtagcacccagcagagtaccttgctcacaatagtctttaataaatatttgctgaattaaatgttagactctcaaatcctgcacaacagaaagtctgataataaacaaagcgttttggcagggcacggtggctcactcctgtaatcccagcactttgggaggccaaggcgggcggatcacctgagatcgggagtttaagaacagcctggccaacatggtgaaaccctgtcactaatgaaaatacaaaaattagccaggtatgatggcacacgcctgtaatcccaactacttgggaggctgaggcacgagaattgcttgaacccagaaggtggaggttgcagtgagctgaggtcgtgtcactgcactccagcccaggtgacagtgagactctgtctcaaaaaaaataaaaaataaagagttttgaagatacggttttttggctaaattttcttaggttaaggatgtattatttcagtgtcacgtcaccatcacgcatcatacctgtattgtttcttaatatttttgccagttaagtttagacttttgaaaattctatttacttgatgataatactgaaatttgtcctccagagactcagtgtctcataatatggaacactttgatttattgatttgacagtcatttaatgaaagcctactatgggtaagatagtgtgctaagtataagaaatacaaagtactggtcgggcgcggtggctcacgcctgtaatcctagcactttgggaggccgaggcgtgcagatcaactgaggtcaggagttcaagaccagcctggctaacatggtgaaaccccatctctactaaaaatacaaaaattagctgggcgtggtggcaggtgcctgtaatcccagcttcttgggatcctgaggcaaaataattgcttgaatccgggaggcagaggttgcagtgagccgagattgtgccattgcactccagcctgggcgagaagagtaaaactccatctcaaaaaaaaagaaaaaaaagaaatacaaagtattgtatacagtgatgaacgaaataaccaggacctcattcattgaggacttattcattacagtcttataatttttaaaagggatatacaaaaatatatataaatttaaaattttaaagtattatgaaggaaaaatagaacattataaagtatctagaacctatgtacggaaaatactgcactatgggttttttttttagcattttcttgaaaatgatttatttctcaaaattctttgaatgctgatttcattttttattgttctgtcatcacccaagtaatcacgcatacttgcatttattttcctctaaggacttttaagcattaaacttagaaaatgttcatataaagaaggcttagagacataattagctcaagagactgatttatactttaaaaaaaatcttctagtagaacttctctgagtaatttttcacatttttaatgttcttcccagattaaaatacaacattttctaactgtaaggagaaatgtaatttgccaagtatttttttctctatattattttaaattgaaagtaaaatggtggattaaacttgttctaattttcaatcacaatgtttaaagaatatgtatggtaattgtgtacctattgtatacatattgtgtacacattctcattgtgcacacacatacgtatagacagagagattcaccaagccagtctgtctaggaagcctaccactaaataaatgtcttacagctgataactgttaaaaactcatttgtgtttgaagccaatgttgatgagtttttctgtggatttatgctgcaggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggtacaattgtggcctattctgtataatagtattatctagcactgcaaagaaaactagaagaaaaaaatctgttttctttttaaatcaaagggtcttctcagataaatttgctacataaaattattagagttgagtgctaacaaacttttagagttaattcagaaaaattcagaaaagcttaatgctttttttaaagacacaaattagaaaatttaaattatagaaaacttttgcatatagacaatggtgctataaaagcatccttttatagtcctattttatcacctcacattgaatgctgaattgttttttcaactgcatgtggactgactttcactttgttatatgcttttttttattatggtagtaaaaatacaacaaatatacccccttaacagatttttaagtgtgcaatacggtattgttgactataggcacaatgttatgttgttcagaaatctgtagaacttaattatcttatataatgctacattcttttgtctttcagttaagcctcatgagcagtgggagcttatatactataaacaatgaaatgggaaaacaaaggaataaggacttcaattagagagaggaaatattctctcaattaaatttagagattttccttctgtgttttaaaattattgttccaatgacatatatatatatgtgttttttttttttttgagacagagtctcactctgttgcccaggctggggtgcagtggcgcaatcttggctcactgcaacctccacctcctgggttcaagccattctcctgcctcagcctcccaagtagctgggactacaggcgtgcaccaccatgcccggctaatttttttgtatttttaggagagacggggtttcaccatgctggccaggctggtctcgaactcctgacctcaagtgatccaccagcctcggcctcccaacctgctgggattacaggcatgagccaccaagcccggccccaatgacatacctgttttttaaagtaaatggcaaataatttttgaaggtaacattccttttttgaaaattactataagtttcaaaacatgtttttttgaaggttcatagcagttttatttgtaatagccagcatatttcttttgaagtaaaaaggttaaatctggtgttttattatgaaaaagcatatatggaaaagttgagaaataccccatcagtgttttgtagttgttgttaatttacatctcctaagtaattttttgtttcttagggagtgtagagaaaatgcacacacacttttccctggtcatgtgaaaaataaagcttccaaattgaaatttagagcaactaagatacagagacaacagagcaaaatgtttttgagcctttggggattattaagaagtaaatgttgtggagtgttggcatactttgaactttctcttaaatattttagcaacttttaggaaagtttatatcaatattaaatatataacatcatgaaatagtttgtttaacctgcttattttaaaggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccaggtaacatttgctactctgtctgctctcaggataaatgtgccttttattcctgtagtttttatgtttatcttaagatgttttctccagttatttaaattgttctctccctggttagagcctaacatcactcatttgaactcaaatccgggaatatccttacaagtagaaagcaccatcagtgctcctaagactgccatgtaaccacagcagcatatctttatagagcagtggataacagttatagtacattccttaactttatcccctttaaaccctgaaaccacttgatgaacttaggagggagttatagtcttcattttagagatgagaaaagcaaggcttgaagagatcaagtgacttgcccaaggtcactcagcttataaacgaagtggtcagaatttgaatacaggtcttctggatctatgtgaaattctgtatttaggcagtataacatagcggttaagagcatggactatggagttaaactggggtcaaaagccagttttgacatttactagctgtgtggctgactttgggaaagttacttaacctctctaagcctcagtttccttgtctttgaaatttatttaataatactgacttcagaaagtgattgtgaggattcagtgagatcaggcatataaaataattagcattgagcccagcacctctagaaacacctcagtaaatgttgttatgattaatattaatacctttgcgtcactacctattagatacagatttcatgttttaatttgtaatcccagctctttcactattctatacctattctaagtaattttctttagagatatttgtgtatcttaggagtgtctgtatgttactgcaggacatctagagagggaatattctctcttaattaaatttagggattctcctgtgttttaaaattattgttccaatgacacatatattttttaaagtaaatggcaaataatttttttttttgagacggattctcgctttgtcgcccaagctggagtgcagtggcgcaatctgggctcactgcaagctctgcctcctgggttcaagccattctcctgcctcagtctcctgagtagctgggactacaggtgcccgccaccatgcccggctaattttttgtattttttttgtagacatgcggtttcaccgtgttagccaggatggtctcgatctcctgaccttgtgatctgcccacctcggcctcccaaagtgctgggattacaggcatgagccaccacgcccggccaatggcaaataatttttgaaggagacatttcttttctgaaaattactgtaagtttcaaaacatatttctttttttgaaggttcatagcagttttatttgtaatagccaacatatttctctatttgataggggtaggacaagaaaccaggaccaggagatcagaaagtaagcagtaaatttgaaattaagaagataaacctgtcatcagggactaagaatcagggactaggaacagataatttgtgtatctttgagatcaggaagctaggcaaagggttgaggtaataaaggattgggaactcaggtaagaattgtgggccatgggaatgggatattatatataactaggaccttgataatgagctgatttcttgcacctgacccacaacttttgtatgttttcttttgaaataagatcaatgtctaatggtactcttcagccctggacatggaaaaagtagtagattctggcaagcagtatgtagtgtgtacaaggaaaaaatacatttatggtttagggaaaattgtttctcagtcccagagatttgaatgtgaaaatatgcatgattttgtagctagatcaaaaggaaatgccatctcttgtctttttgtgactgctaacactctcttaagaaaacattttggaagttgtatctaacatatactttaactttttctaaatcattcacagacttcaatctttataatggaggaaagtggatcaggatatatcttactaaggagttgtcatttaagctaaaggataagaaagagatggctacacagggagactagatgtatttcaggcaaagaaaataatatagacaaaggtttggaggcagttaagaagaaaaggacaaccagtggggctagaaagtgagggaaagggtaagataaagcagtattggagaaagagatggtgaaaaattatttacggttttataggccgtgagagacctacgtgatatgaatgtttttcttaagtgagatagaaagtcattaaaagattttaagcagtagactgatgtgttccaatcctatttctactttgagatgattatgatcacttctacctccatatagattatacagaggccagactagaaataggaagaatacttgtgagccctttgcaggagatgatagtgtatggaccaaggtgtttgcagtggagatggagaaaagaaaaagaaaagagggaagatgtgaaatacattatagacataaaaaccaaccggacttgctaaacttattaatgcaccacacatacgtgtgaattaaagtgaggaatcaaggatgattcctaagcaagaggaagcttgacacatttgaggaagaaatttaagaactaagcctcaaactaagaacacgtttgaggaagaaatttgagatctgtgaggcatccaagtagaaatatcaagctgattgttgaaacacaagcctaaagtttagaagagagccctggactagaaatataaatttggaagccatcaacatagagatggtatttaaaagagatgggcatggtaacttatgcctataatcccagtattttgagaggctgaggtaggaggattgcttgaagctaggagtttgagaccagcctgggcaacacagcaagaccccctctctctatttaaaataataataaaatccatggatgttggtgaaatcacctgctagagggtagagtcagaagagaagagggcccagaatgtatccctaagaacatctaacatttgaggggtagagaaggaagagccagcaaagaagccttcctcagctttttcagccagtaaggcaggaggtgggaaattagggcagcgtagtgtcgtgaatgcaaagtaccgctcaaagatcaagggaaaatagctcaaagaagtatccaatggatttggtataatggagtttactggtgacctcgacaagagcagttctaggggaagatcagggaagaagccagagtgttaagagttgagttatgaatggggaatgagggattgaagaggagataagatgagcagataattcctttgtctatttgctgataaagtggagcagagaaatggtctggcagctagagggggatgtgggctcaatagaaaatattggagcacatttatatggtaatgaatgagccagtagtcctggagagagagcacagaagagagaaagtataaggaaagttgcaaagctcttgcaaaacaggaggggccggcatagagagtggtctttggtaacaggaaaaacacatcctacattttaacaggcaaatgagaacttgggtacaaatataggtagttgtgtatgtttgttggtgagaagatcaagtggatcggatatgatcacttctgttttctcagtcaaatctgaggcaaggccatcagcttaaataatctgctatgtattttccaaacctatattctctgccttctccagtctatcctgcataacactttccacattgatcttcctcaggtgcaattcagtttccatgtgctccagtgtcttcagtgaattcctaatatttatgaaaataattgttaattttcccatataattccaaattctagctttatctctcagtagtcttttccttacaatcttcatttggtaataggtagtattatggtagtaatgtattatggtagtctacaaataatggctcgtgggccaaatctagctggccacctgtttttataaataaagttttattggaacccagccatacccattcctttatgtattgtctgtggctgctttctgctacaatgtcataggttagttaggacagagaccatatggcccaggaagcctaagatgtttactatatggccgtttagagaaaaagtttgctgactcttaattttgatcagactgatctcttcagtctaacttagtggaaagaacaagagctgtggagtcagacagacctaagattgacactggataccaacggtcactgaaacttaatttctatatttacaaaatgaggatataatacttaaccttccttgttgtcgtagggtcaatataacatatataaaagcatatgtttctgggatttggtaagccttcaagacaagcttctttcctctactcatttgctgagactactgttctgctgctttattaggaatgggcttcattgtcttccccttacacctccatctctgcccctcagaattctaattctactcatctttctatgtacctctgtagtgaaacttttcctgattgccaacatacggatgtaatttctcatagactataacttcattaagaaatagcaattacaattttttaacagcaaacaacaaaattgcaattgctaatacttaatgaacttattagtatatgtatacccaaacatgttttataccttaaatatagacgataaaaaataaaaaagaattagcaattacttatgttgctattctgcagattaccacacatggaataaataccaaatagttatttgctcattcaattcagtggatttaaaggggagggatcagtgtggactgtcattttttagtgaagacttcattaaggagctacgtccaaatgtattggtgatcaatgagggcatagtgagaaactgagaaaaatgtaaagtcaagtagagcctatgacttttaattatctactttatgatgtaataaccttgcagttttctgtgaaaggttctaggtgcttatactagttatctgttgctacatttaaaaaatgaccctaaaacttagtaggttaaaacaaaaagcatttattatttcacacagtttctgagagtcaggagtccagcagcagcttagctgggtggttctggcccaggttctttcatagggttgcagtcacactgtcagatggggctgcagttatctgaaggcttgactgaggctggaagatccacttccaagctcattcacatggccattggcaggaggcctcacttccttgagatgctcacaacatggactcctacagagcaagtgattagagagaaagagagggagtgcacgagtgtagctgggggtggagggggagagagagagagcaagagagccagagcgagcacaagtgcgcatacgtgtataaccaaaacagaagccataatgctatcacaattacatctgctttattttactggctgtgcacatacggaccaacctggtataatgggcaagggaactacacaagagtatgaacaccaggacgttgtaggtcattggggcccttcttaggactagctattacagtgcttgatacctgggtagttatttatcccaagggaatagtgtttgcctgttcatatgaatgaaacaattgtaatctaattggtgtcaatgtttttaaactttcacaaagattttaaaacctatgtcattgtgaatgaattcttttcaatttccctgacatgaggttaaaggacttttagtaaaattatacctacactttatattatagaataatttctgttttctgtccagttgcctttcacttttctgttgaaatctggatttcctttttcccatttaatcattcagattatttgctagatgaaatgaccaaagaagcagagatagataattcttcaactgtagaaagccttggagaaactactgatatcttaaacatggtaatgatttcctatctatttatctaaatatgagtttgaattttagttcattgtgtatgtgaatgtgtgtatacttcctatactcttatatgcatgaaagcgtctttctcgtttcttactttattttttaaccaactatattgaggtataattcacatacaataaaatttgttttgatcctcacattattagtatggcaattgagagcggattctattactatctgaactgttttcccttcattttatatatatatatatataaaaaaatatatataattgaaaatatactatatatttgtactatatacaaatatatagtatatatactgtattctttttataatatatattttttatttatttcagacacacatcatgagcctgaattccaatgaaaagtcattaaaattatcaccagttcagaaacaaaaggtataatatgaagatttattttcgttattgttggtgagagcagtttaagttaattttttggatggtttttggaaagaacacaagaaacgtaagcatttacttactttagaatttaaaagacagagggatacaatgtagataacctccattttgccttgttctgatggtatgtattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaattccttttaagctgacatatattttatactttctatagtctttttaagtttaggccctaccaggcctactttagtaaatgagaaaagatttattatactatttctgtgtattaacttgttaatttttaacttgtcatgttttaataatttctttggcacaataggaacctcttcctaggcctaactcatcacaatttataaaatttgaattagtgaggttttactatccagagacccaaattcattagatatttgcatccattagcttgtttgtagaatttagatcaacaatttggttttgccttattttgtccagcaggaaattaattttgtattgttaatgtattattcaaatgtcagtgtttgatttcatagtttttgtacaaatcttacattttacacttaatattctttccttagtgttctttcatttatagaaattattgtaattaaataatataatcaatgcaaggaagaaggtcaaaaatttgaaaactcatgaagattttgtttagaaaagaaaaatatattcattattatttagtttatagataaaaaacatctcatgtgcagtttcttcagttctaggagtggactattcatttttttcaaattttacatttttatttattttgtgaattttgtggactcaaaagacaaatgaaaatttgaaaattaggccaggcatggtggctcatgcctgtaatcccagcactttgggcggccaagatgggcagatcacttgaggtcagaagttcgagactagcctggccatcatggtgaaacctcatctctactaaaaataaaaaagttagctggatgtggtggcatgcacccatagtcccagctactcaggaagctgaggtgggagaatcgctggaacccaggaggcagaggctgcagtgagctgagatcatgccactgagctccagcctaggtgacagaatgaaactccgtctcaagaaaaaaaaattgaaaattaaagatgatcgggaaagtgggaaaaatatactaagctgtactatgtataagaaaagtgtacatttttttctttgaaatggaatttcgctcttgttgcccaggctggagtgcagtggcacaatcttggctcactgcaacctctgcctcccgggttcaagcaattctcctgcctcagcctcccgagtagctgggattacaggcatgtgccaccactcctggctaatttttgtacttttagtagagacgggttttcaccaggttggccaggctagtcttgaactcctgaccttaggtaatccacccgcctcggcctcttaaagtactgggattacaggtgtgagccactgtgccaggccaagaagtgtacatttttaaatagcatcttgcaaaattaatctcgaagttttatgtaaggattgattcggattgagaaaagaggcagagagtaaatattgatggtattgtgattaatggcaaaattatggcaggtagtaagaatcgaaaattaaacacagatacatgttactaaatcaaaattagatgtatcacagactagagagtggcacaaatgatccttaaagaaaacaaaactttagcaaaatatctggtaaaacttgctattttgattctcctaaacttataaaaatgtaaaatcttggcagtatttaaagtagataagttgtccttgtcaactaatagtagtatgacatatgataattacttcaaaaaatttacagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgtatatagtcagaaattctttatgaaaagataaactgtctagtattagatactgaattttagagaggctagatttccactagagtaatttcaattgtcccttaaaattttccgtgtacataatgcagctaatttatctgatagtttatttgtggctcctttttcaactaatttcctttcatagtcccttttatatcctgggcatgagagatttcttatacttagttttattaaggaggattttgatgagaaacttcctgtgagttttgtgtagttgagttcttttgcacagttgattctctgagtgagaaagaatatgaggaaaaagtctagaatcgtatgaagtaaaggatttcctaggagcaattgtaagttttgccttagctgcaaggatctctggcagcttcccctaactaaccaaatgtactgatttggcattgcattgctttaccgaattcgaccacattcattaagggatagtagaaaagaattaatactatgataaaaatatatgtgccgaacatgattatttaaaaagtagatttaaaataattaagatggatgacacagaattcataaagaaaaaaacctccagggaaatgagaaactcttaaactcaagttattaatgtaatagctatgagcattcatcttctactgaagagataatcagccagtaatacagaaacaacgttctaaaatacacccatctcagtattaaacctggtctatatgtccacgtttaaatagcatttcttcacatttccctggccaaaaacattttgtgctctttagaagtggtagttcatgcaagcattgttttctagtggagaacactggcctccctagtcactttgagaccaaagcccttcttctggttttgtacttttgagctgtctgaacttgggctagtctcttagctttgcagtcctcaatttcttcatctggaaaattatagaatgagaatgagtgacctaagggattctataggaacagcagttgttcattaccagctagagctctgtcacacccagattttctgcaattcctttttcctcaataaaaaatcttaagtctcgtcaccaaagcgaccccacattcaaactaactagtagttatactaaagtaaacagttatcctaaactactaagcacacactaactttctgtgcccactgttgggcgaacatttatttaatcacatgtggcaggtctagtaccctcaaaaagtttatggagaggagtgtattgtgggttaggggtgggttggggtacaaaagacccaggtctatccaggctttcatcgacagaagtgatttacatgtttgtaaattttatatatcttaggagaaaaaaaaggaagcttaagaatgagaccactttgtccctcatgaattaacacttggttatatagattaaaataactggttccttctttattgttcccatctgctggttgttcaggcttttatagtagtttattactgatcattattgagggaagtgtgagtagtatatatagaatccattgagttacatttcctaatgaggactctggctgaaaaagactttaaggtaagctgcaaaggattacctaccacagaaactgctgctgctgctgctgctgctgctgctgaacagcagcagtcaaggtgagtgcaactgaaatgtcttctattatttcactatagagaaacttgctatacacttacatagcaaaaataaaatgtgaccatggaagaaggaaaggccaagcttttcttgtttctgacctggagaactgagtagaaagagtactattcagcaagatcgagaataagggagcagaagcatgtttgggagacagttttttactgttgattttagattgtaggagatgttcaggaggcagatacctgtatggatctggagctcacggagactgctgagtatcgccagctcatagatgtagttaaaactggatttgactgaaaggaagtgttcctaatgtgaatggaggagagttgaagacagaattcagagaaatgtcagtaggtaagggagaggttgagaaagtgaagtctgagaaggaggtgtgggagcatacttactaggaaagagagataccacccaagccaaagaaggggtttcagagaggaaggagtggtagtagctgcagagagagcctctaggaggcagcctagtagagggccaggggcagaacccacattgccaggaaagaatgagctccgggaaatctgctctgcagaggaatagaatcagaactgtgaaaattaaatatcagatatagatatttaatttttaaaatatttaattttttaagcatatttctcaatttaggaagggagatgtgtactccagagactttggttttctggggaaaagatgataaattttgttcataattaatatatacataagaatagagtgttattgatgtgagcttatgaaccaaaagaaaaatctgcaatgctttaaacattagtgaggcggagaaaaaaaacatctgtgagaacagccattattatcctcaaattaaatgagcaggtttggaaacaaacatgggctccaaagtccagtagaactgagttaaaatcccagccctccactgatgagctgtgtggacacctagaaaagttgtggtggtggtggtggtggtggttgttatttgacctttctgagtcttatttccctcatttgataaaggaagggacttttgacgattaaattacctaacacatgaaacatgttataggcactcagcaaatggtaacctgtatcactctaattatactctgtgatcacaccaaggtaggtgcaaagctacactcatgaatctccaggtcactgactgatgtgcgtgagtttagtcatgtgaacctgacttttgtttaaatgtaacataatagcaaaatataaattggcttatagaaatagatctgtgggaataaagtagattgcaataatgatcatgcttaagtataaggtggagtgaaactattacacaccatacattagtcaataaatgcccctaaatatttaaagtgtgttgaaacgctgatcacactcatgtggttagccgaaaatttaggtgtgttttctgtcactgaacatttccctctgtgtcctaaccttgttatcaaaataaataaaaataattagcacataaggtatagtcgtggatcatgcatttgtttatggacaacaagaaaatcttctaaggaaaaagagtagagatagtaaagaataaatctgaaaatgagaataaaaatgctcgccagcaagatattctatactctgaacatttatttctgtaggcctgcctatcaaactggaatgtattcagtggtgagaatacaggattaggaatgacataagggagtggtgcctagaaagaaggaagagtttaagagattataaagtagtatgatcagccaagaatttggagatcacaactggcagcccatgggtgcagtctggcctgcagacttattttgtttggtgcagtttttttttatttaaatcatattggttgccaacattgaaatgtcaggagattttacatttaaaaagtttctcagccaggcatggtgactcacacctgtaatcgcagaactttgggaggctgaggctggaggattgcttgaggccaggagttcaagaccagcctgggcaagatgataaaaacctgtctctacaaaaaaattaaaagattagttaggcatggtggtgtgcgccctgtagtcccagctactcaggaggctgaagtgggaagatcgcttgagccctgaaggtcaaggctgtagtaagctgtgattgtgccactgcactccagcttgagtgacagagtgaggccctgtctcaaataataataatgtttcttggacttttggaaagcctgggtctgggagcatcacactgtggcaacactgacctgaagctgagctgaggctggcacccctctccccagttcccatggctccttccctcactggccttgatgctaggctcctggctcacaataaaaggatgtatagaggacacaaaaataagtggacgttttaaatgaactattttccagtgataagatctgggacattatgggaaaaaaaagtccaaacttactgtttttcgacagtcctcaatgcacactaagaattctatcttactttttatggaggggcctctacaaaattatttatacttatatacaaatatatagtatatgctcatgttatttttctctgtaaataatctttttaatctttacacaaaccctctgaggtaggtattgctaatgttatttttccattttacaggtagactataaaatacattcactgggtgccatgctcaggccatgagtgattagattaaggcttggaaagcagtgcttagggctttgtatttaatgcccttcccaccccatactgctgtttccatgattttcagtgtagttaaaacatgaacttacaggttaacttttcctgtccaaaaaaaaaatatatacttgaaattttgatttttctacctgatataacttaaatacaaagttttatgctatattaacctatctgggaaacattttctaccctacatgacattgaagcatgtcagaaattctgaattatagcacaaaattttatactttatagctctggtttgttttattacttttaaaaaactataatacccacggacaaaagtgcctatctcatacatgtgtccctcaatatatttttcacaaagtgaatacacccatcacaaactgatcagcatccaaatcaaggaaaaacacagtaccagctccctcagaagcttcactttaacccctttcagtcatttcccactctcagccccaccccccagcccccatcccagcattctccttaaagcatgcgatgtaattgtgttcttaagtaaacagaaacctcagtaggaacctttgctctcttgttctgttccttaagaaatatgaaaagtgttgccttgggccagaccagagtctgcacctgactgtgccatgcctgaccaatgaaacaaagggtccttttgtgagaggtcaggcccattcacttctttactgtgatcctaacgcaagacacagacatatactgaccatttcagactacctgtttacatcttcttagatggttctagtgccaagaatgtacttaaactttactctttctttttataaaatgacagtattctgccagtcactcccaaattgtttcagtttaaaaggtaagtgctttctgtgacttcaagtagtcgtccagatgtgtttagaataattttaaatgtgcttagtctgtgagtgctatgatgtgatttctagtgaaaatgtcattttctaatagctttctcaaatttagaaaatgatatagttccaaaagttcttcattgttatagattgtttaaagttaatgagtaaaattgtagtttgttatgagtgttttacttatttctaaaataaggtaaaactcccacgtgtctttttataatagcatgacattatcctgtggttacatgaatacctcagttaacaagcccagttggagttgacccaggtgctaggttagccaagcttcccaagtaattgaggattatgctgggaacacagctcactgatccctccctctgtgaaaagaggggcatagtctgaaattccttgtctcaggagcactgttctttttagttaacctttcatttatgtatatttatgcagacaactatcagtcataagtcttaaatctagtaatcttcccattccctttcaaagtgaagttgtttctgataattttagctacccataatgtatacctggctaggcatgatacacaatataagtcactcaaaaggggaaatcaggctgggcgtggtggctcacgcttgtaatcctagcactttgggaggccaaggcgggaggatcacctgaagtcaggagtttgaggccagcctggccaacatggcgaaaccccgtctttactaaaagtacaaaaatcagctgggtgtggtggtgggtgcctgtaatcccagctactcgggaggctgaggcaggagaatcgcttcaacccgggaggtggaggttgcagtgagccaagattgtgccactgcactccagcctgggtgacagagtgagaccctgtctcaaacaaaagcaaaaaacaggcggttggaatcatgcagacaaaaacaaagcttaaaagtaaatgataactacctcatgttaaccctacccagtctaatcaatcatcatttgaaatagctgtctgccctggtaccatgttcctttctcccacattcctctcttgcatacattgcctcatgaccttggattaacctaaatctaattcttcctgagtagcttctgaaactctttttaaaatctcaaagctttatttacttagggcttcctgtcctcagtgggaatgctattaggccacgcctttgcaattggcctgaggatgacactaatgtttactattaaggtgtactgtataaacatcctcttcctagcctggactctcgcattttatatttttaccagaagaaaggtgagttaaattttagaggcattattttccaaccacctactaaagattctgttgagtatcagtcaggctttatccttagccagacagctactagaaagctgaccatcaaaagctaattacagtgttgaaggggatatggtctgaagcaaatattgccaaggtgaactttgtacaaatgttatttgaaggagtaaatggcactgataactgcttcacatattttagaagcagttataataaacttaattataataaactataaagttataactttagtgaagtgtgtaaatgaaaagtatgggggggaatctaatgagaaacctaatatcttaatgacaatcagagtatttcacccaaaattagaaagttaaaaaaaaaaaagaaatctcagtgtagaataaaggctgaaactaatattttctgcctatacttaataagcattccatgatttactatcagtctatcaaatccatagacagcctcttttatcgtttggattagctggccagtagccagacagaacaagttctgcctctgtttggttttccttctgcttttaataaccatgagcaaaccatttaaactgtctatgttcctttatcttttttcctggaatgtaaataattatacttatcttcctcatgactgtcagtgaatcgtacttctgaagtgattctaaatccctatattttggaaaatgaatataatatatagatatgattatgttataatgctacagtagacagaacgctttttaaacttttctcaaggttgaaagcattgtgagacaaccaagaaagagtatttattttttttttccattgtaaccttgccatgggtgctagtaagaattttggaaatcctagtcattgaaatagagtggcatgcgtaaaatccttgttaatacagtaacttgatattcagcatggactgtacagtatttttttcttcggcttcaatatttgaattaatattttcctggtttttttagatgacacaaattatttatgacagcaatatcaaatccctcgttttttaacaagaaaatcttactcttctctgatggtcaattttgtcacaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaaggtatgatgatagatgcttaaatcctgagatcctgggagaaaacatatgggttctctagtttctgcagaggacagattccagttgcctttgggatcagaaatactcccatgaatacatgaatacatgaattcatgtgccataagagaaaggctttggcttatttgtgaactaagcaaactttgtctctagcacactttctagaatgctgcttggtagcattctgcctcccgcatgagtggaagtagaatggtatgggccaggatagtacaccgttgggaaattaaccaagaagttcagcactcagtccttgaaatgctgaaagtgcaaagttaggagccctggcactggtggcagaaatggggtgtgtatgtgtacacacacctgtgtatgtttacatgtgtgaatgattgaaagttggtcacagcagtatttgaagttgtgatcagttcttcaaaggtgcagtctagacaaaattatgtatagaaggaataggagaagatatcactaaggaagcaaaaatcaccctgaaagtggagctagagaagcccaaaacataatctcttccattggcagttttgactgagagtgaccttgctaggagatagtttgtaggtttgaaatcatttgtttgctaacactactctggattaacttcagaagtatggaattccgcaacccaaagtgaatgacgttgtactgattcatctttattttcattttttgaacctctcatgcagaacactgagtcataccttctagtatgaaacactctcatcattggtctgttgcaaggctcttctcatgtaaatgtattctcttttagctccattccccttcccctttttccctaacatagacaaccactgaaacatatttgtcattttatttgaatgtgtacttgtgaaacatgttttgtgtgcatacatttttaatttacaaattggtattgtggtaaaggtcattcttttgcttggttccttctttatccaagactcctttctctcactaagaaaaaaaatattctagcagttactgttttatttcagaaggagaaaatgattctgtttatagggaacatttatgaattcaggttagggtggtccttaagattatttaacatagaaatcattaaataccaatttgacattgtaaaatgttgagacaagttgtatgccaattagcgttcatgaatcttctttgaggagaattcttgagtcatacagtttttttaatcacacaattttaagctaggaggacatttgcaatcagtcagcatctaaggcccctcactttacaagagctcagcaaagtgaagtaattgtcacatgtttatgtcattagctagaggcagactctagaacctgcttaaagattcagacttaagttttctagaacagcacaaaaatattttttgttatattgctttgttattgtttatagaaagaaaaagccaacctagaggaacgggccatttgtgagtacaatgaaaacccaaaaggtatgagcacatttgataacatacatatatacatacatacatacacacatatatatgtgtatgtatgccataattgggtaattataagcttacatataagtttacatatatgctataatttttactgtcacatgatcctcataacaagctatgaaatatgtgatacagacttatctgttcttatatataaccaccacagcttcttcacatacaaatattgcattattcatggctacttatgtgtcaatgttaaggaattttttatttttttttgagacagagtttcgctcttgttgcccaggatggagtgcaatggcacgatctcagctcattgcaatctccacctcccaggttcaagtgattctcctgcctcagcctcccgagtagctgggattacaggcgtgtgccactacacctggctaatttttatatttttagtagagatgtggttttgccatattgtccaggcgagtctcaaactcctgacctcaggtgatcctcccgcctcggcctcccaaagtgctgggattacaggcatgagccaccacacccggctggtgttaaggaatttaagtagcctttttactaccttttttctctctattaaatcagtattattaaatcaagcttttgccccaaattccaatttatatctctagtgcacactgctagactccattgcccaaccaagttgggactactgggctggcctaaagccacaatggccacccagttatttacccccgagggctcagacctgagtgtcttaccgtagatactgaagagaagtcctttcccaagcctacctatcagtgtcagagagcaggtgctgtggaatagaggagactgtgattgcccttgagatctacataatctagacacaaatcatctgtgtttctgtagtatgactcccacattgtttccacaccatcacacggcagtatgattgtgttctcataaaaaaataactatctgtaatactggatatctgatctaaacttaagctgaagaatgaatagtttccttaatcctgttccttttaacttctgccataagagtagtaagttttagaatattttaggcaagtgttaaaaaatgtatcacctataagtattcttaacatatagcctaaagcactacaaagaaattaaatataagcttaaaagtagttgataatataaaattaaaacaatgcatatgcttcacaagtatactttgaagataattattcagatatagaacatgtggattaatttgaaacaccaaaaaatagcatgtccatttgagtacaaagaatgtaattataactaggttaatttttaaagtaatttgtattttacagaagtcttctctaacattgactattacctttgtagctatatttggatactggtcatctaaacatttacaactttggtgaggtcattctgggcttttcactttaactcaacttttcaggaaatatgcagtgtagatgttgtccactactccaggggtgagctcttttcgtattaccccacaactcagggttcatagagtttcactgagagcatcaggtcttgtctttttcctattagttaaaactagtatttctgaatgatccaattgtaggatacatgcttgatgatgcagatagcagttcattagaaatcctagaaaacagtgaaacaacaccaagcaaagacatgaaaaaaacaaagaaggtaagtgaaatgaattgtcttttttgatccttttgaattcaattgtttgttttacttttcatatggcaatccacataatttaactctcttaatatgagttttcatggccccaaaacctgaagaatttcaggtgatgtcgcatatttttaatatactacctttcctttggttagcatttgaatgatgatcttcttttcatccttttactttagcttatgttttagatgtgtctcttgtaaatggcctatacagctggattttgtctttgacatttttaacatgcatacctaaaatctaaagctcatcaatgttcctatctttttcccaaataatgccaggaccttagaagaattttcttgcctatcacctcttctttcttattttagaagttatggtacccagtatttaaaattttttaacatcacaaatcgtatgtttttagtattttttatactacttttttactcagatgtcccctctggaattcttattcttcctgaagaaatattttggaagttcctatcacagatgtctgttgacagttaaaacttttagtttctgttcacttgaaaatgtctttattttaccatagttcttgaatgatagtgtggctcgttgacagttattttctcttagtatctgctcccattattgctgtctataattttgctttagtataattgctgataactttgtatataacctgccatttctctatggctgctttttagattgtctttggtgtgtttcagttcactatgagatgcttaagtatggatttttttttttttttgagatggagtttcgctcttgttgcccaggctggagtgcaatggcgcgatcttggctcaccacaatcctgcctcccaggttcaagcgattctcctgcctcagcctcccaagtagctgagattacaggcatgtgccaccatgcctggctgattttgtacttttagtagagacggggtttctccatgttggtcaggctggtctcaaactcctgacctcaggtgatccgcctgtcttggcctcccaaagtgctgggattacaggcgtgagccaccatgcccagcaggtatggaatttttaattttaacttacttggaatttattatgactcttgaatctgagaattcatgtcatttgtcaatttttttaaaattctcatccattatatatttgaatattttctctcccctctttcaaattctgatataaaactttttattttatgggtacatgtcttttaatatcaccttcttgttttctatgtgtaagtgatattctgggtaatttcagggccttcatcaatttcatagtttctcttcagctgagactacttggctatttaacctacctatttaaagttttaatttcagtgataacatctttcacattttaagtgaagttgtatttttgttctttttcaaatcaatctggtcttttaaaatcagtatcttgttttatgcttactttttttattctagtcttttaatttaagcacacttagtttacattctgtatttagtaattccagtgtcatccttagcagtctaaatgtgtgttgctttggctgacttgctaatggtgattagtttccatatgtgttttgaaatttgtattgtgagttcatgtttcactggtactttttttgtggaaatcctttaaggcctctgttagagtaagtctatctatagagagtttgcattagcctttattagctctggagtgactgaaggaccactttaagttcatttctcatttaagggtagaccacaatgtttgtaggtagacttatattaagggcatagtacttagaaggtcctcacattatgtaggggtctcagttccagttcccctcattttgtgagatcaaattgtttcaaagttaaaagtctaagttatgagtcagcagatgctatttcagttcttaatgacctctgaggcttcctgttccttctttcttttttggtctacaaggatttcccttagtttttggggagattacctgcacattataaaattatattttttatacttaatcagcatttcttggtattttatagtggcagtctttttgaagttgtgtatttcttcaccatagcaggaacaggagttcttccattttaatccatagatcctttttctagattcttactttttggattatcactttttaccctagtttctccactctttaaagctagaagtaagctattattattagcaccatttttatttctggaagagccaaattttcacctggtttttgtttcctgctttttgttttggcatcttgtcaaaaccattatttgtgttaccactcttcaataatcctattttcttcctggctacattctcaaagggcctaaatcaaatgaaacttttatcaccttcatctcttctgcatacatgccctgttggccactcccttcttgatgtatttttctctcctgacttctgagctgcctagttttcccaattttgcacctacaaaccttggtcctcagttctagctcctcttctgcctgcctctcactctgctctttttgcctcttttcttatattctgttttctacctgcctggaatctctgggttatcggggctactttcatctctcagctattatctatattctacatatctgcagccccagcctcccctgagcagcagctctgtatatttgactgcctactcagacccacacacagggctcacacagccatcatttggcagcactgacttttttttttttttttttggggacagagtctcgctctgtcgcccaagctggagtgcagtggcgcgatcttggctcactgcaagctccgcctcccgggttcacgccattctcctgcctcagcctcccaagtagctgggactacaggtgcctgccaccacgcccggctaatttttttttttttttgtatttgtagtagagacagggtttcactgtgttagccagaacagtctcgatctcctgaccttgtgatctgcccgcctcggcctcccaaagtgctgggattacaggcatgggctaccgcgcctggccaagcagcattaacttttttgccagaagttctcatctacaggaatggggaggtacatcgtccttcttcagaatattacaatagaaattcactgtagctgcgatacactgagaatcacagacatgtcctgaaaatgacccctcctggatacatttaaaagttacaataggtaactttaaataggtttttatatattttttctcttacaacttaacaaagtgaaacattaaatttgttctttgaagaaaaagatatcaccaaggtgttgatggtgttgaatgttagaccctgagaggtcttgttttagggtggaatcctgactgccttttggtgaaaggaaaaactctaacagatgctaagaatgcaccatagtacatgtggtgccccataaagagatgacaaaatcatgttcttacgtgttgaaaatgatatcccctaaatactgttaagtgaatgtttcacttatggaaatgaatatttgtgtgtgtggtttttttcctagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttc

SEQ ID NO: 5637 - DNA, 58364 bp, human; identical to SEQ ID NO: 5636

SEQ ID NO: 5638 - DNA, 58364 bp, human; identical to SEQ ID NO: 5636

SEQ ID NO: 5639 - DNA, 58073 bp, human
aaccgtcctctacagcctcctggccccggcgcaggctgcccgtactgcccgtggcatgagggagccggaagagctgatgcccggtgagttgcgcccgcgccggtggcggaaggccgggagggagggtccgcgggcggccgggccccgcctccggatcggccctgtagggggacaggccccaggcttggcagccggactggggcgggatcgctggttgcgctcccgcgaatgactgagggcagaggaccggacgggaagaacaggatgggggagaacgggaaagagggtgcctgtctttcgtatgctttttaaataagctcttgatgagcttcttgaaggcagggacactttttttttttttttatgagacggagtttcactcttgttgcccaggctggagtgcaatggcgcaatctcggctcaccgcaacctccgcatcccgggttcaggcgattctcctgccttagcctccgagtagctgcgattacaggcatgcgccaccacgcccggctaattttatatttttagtagagacggggttcctccatgttggtcaggctgatctcgaactcccgacctcaggtgatcagcccacctcggcctcccaaattgctgggattacagtcgtgagccaccgcgcccggccagggagggacactttctgtaaactccccaaagtgcggactccagacttgtgcactttggaggtcctgagctcccggttatgtattgaatgcagtaaagagtgagtgatcagggctgtggggtaaaaggggatacaggaaataaattggacaaagagggagaagagggaccctttagcgagtgttttttagccttttttttcctgagctccatagttagaaatacttttgacattgtgacccgatactccatatataccgtgtaacagaaatagatgtctggtgaagcagtccttgttctatccacttagattccacacacacctttttgataatgcattcttttaaaatgctgatcgtgatccactgaattgattttctggcccactaataggtcacgaccattttgaaaaaacactgggtttgagcagaatcataccttcactgaaatatgtatgttttcttccatgctcctggccggaactgacattcctggcctgcagttcacaatttagtgagacatacaggaaagtaaacaaaatgaccatataaattgacagtagatattacagggccagagcagagccaccaaaccttggcttgggatgagggtatcagggaagccaggggagccaagacaaaacagttaaaatgttaaagtaattcattctggggaaactcagagtctgttctagatcctagtctcccaactcaattattagttggaactgagatgcctcacagtggttctcaaaaagttgtccacagtggctagtctcttgcgtattaatatttattattaatacttatattcgctatgttttcctttctggtacgaattagtttatgtgtgatcacccaccttgggatttccccaaaagctggacctggcctactatttggtgtatgtgtgtgtttaaatggttattgggaaatggtaggggtttttagtctttcttcaaaatgacgctgtgccacaacagtttgtgaatactactcagatcaggtaatgacttgatgtaagaatgttaaaatctcaacatccccatgtactcctctcccaatctcctaggaccgtggcattttgtgatgatgttttggggggaaagataaaccgtcctttcccatgtactgtttctggaaagagaaaaagacatctctataactaactatagtgcatgagtaagatgagaattagaaacttcctgagtagctgtgttgagaggatcttttcattttataactggatccctaaacattctgaattctcagaaatcaggaaaagctaaagtgctcctttgttgacgacttggtaacctgtcttttatattaacaatgttgaaagttatatttgactacaaactctccattatgatgaattggtaaacaaaacattcaacagttacgaatatacatgtgtgtaagggggaccttttctgtgtgaaaagtagaacacacaagggctactttgtgctaggcaatatgggtagtgcataccctctgtaaccttagaaaatagttggaaaaaaacaacatttggggtaacaaatggtgaactctgtgtttcaacacagaaaagcagtgactttttttttttttttttttgagacggagtcacagtcacactgtcgcccaggcttgagtgcaatgatgctatcttggctcactgcaacctccgcctctggggttcatgcaattgtcctgcctcagccccccgagtagctgggattacaggcgcccaccaccacgcccggctaatttttgcatttttagtcgacacggggtttcaccacgttggccaggctggtctcgaactcctgacctcaaatgatccacctgcctcggcctcccaaagtgctgtgattacaggcgtgagccaccactcccggccgacatttttaaagtatagctttttattgctttgtgatgacctcatcttacatattgtgctacctaccaatctctctaatcaaactgttacacaaatcttgctgatttgtgtaacagtttgattagagagattgctaggtagcacaattatttgccatataaattctacagatcacgtagttcagagaagccagtgatcatttccaactcttatggtagaggaagagtttacagaggtagctattgagctaacactttgaggatgctaggctctgggctaagttctttatacatgtcatctcatttaatccttacaacaacctttgaatacctaattgcctttaaagcctatggttttttttctagctgctttcccttagttcgaatgaaagagatagtggtggagtaatttgtttctctctgtgctgtctccggttttatgggtattcattgggattaccaacagagaaattaagagttcaccattttggccgggtgtcatggttcacgcctgcaatcccagcacttagggaggccgaggcaggagcccaggagtttgagacctgagcctgagaccaggagtttgagaccagcctgaacaacatgctaaaacccagtctgtgcaaaaattacaaaatttagctggacatggtggcacacgcctatagtcctagctactccagaggctgaggcgggaggattgcttgggcccaggaggtcgaggcagcagttagccgtgattgtgccactgcgcttcaagctgggtgacagagtgagaccctgtctcaacaaaaataaaaagagttcaccatttgggctaacattgtttcccttacatgagaacactggaggttccttggaaaaactggaccaaagaaaatccaaattgactgatagagactctccccatggatagcctgatgatgttaatgaggaaacgaaatactgtcctgtttctgtgtgtggagaaaagctctcagtcagaggccagaccatgaggtgttaactagaacaagaatagcacagattgtgccatttcattccagggaatagacatctacttggtgacagcagaactattagtaatagatgactgccttccttgtgatagtatatttcttactttataccagtatatgagtaatacatgttcaatttagtagatttcatagataaaactagaatggagtctgaggaataagaaagactgaattaaggtggaagaaggaaggcttaaacattgccagagtgggggcaaagctgtcatgagacaaggggtttgtatggataaattactcaaaagttattttaataacaggcaacatagtaaaagttataaaataaagaccgtcttatatttgcagattcgggtgctgtgtttacatttgggaaaagtaaatttgctgaaaataatcccggtaaattctggtttaaaaatgatgtccctgtacatctttcatgtggagatgaacattctgctgttgttaccggttagtattacaatcctgaataaggacagtaatacttagaaaattctaaatattttgttatagatatgctgctgtgttttaaacatgttgaaaatattatcaaaagtgttgttttttactttgctggagaattcttcacaaaataagtcatcaagagcatcttttaaattttaagtttccttagtatatttaagtatgattttctatacacacaactttcttggaatgaatctatttcaatataattttttaaaaaaacctgttaccgtataattttagaaactcttttccacctaatagaaactggttatacatagatgaacaaggtaacttatttcaacacagaaaagcagtgacattttaaaagtatagctttttattgctttgtggtgacctcatcttacattatgtgaaaaatgcttcaattgattatttctttttccctcctaccaggaaataataaactttacatgtttggcagtaacaactggggtcagttaggattaggatcaaagtcagccatcagcaagccaacatgtgtcaaaggtttgggatctttttatcttttcacaaactgtataaagtatttttatgttgactgtgtagttctttaatgtcataaataataaagcttttagttctttattttctgacatttgcttgaatattattagcatttaacttatcttttatatgatattcagaactgcttttatatgttagggtctaaaaatcagattgattttaaatccagggaccacaaaggaagtaatgattttacagtattgcatttgaatatcccccatctttttttgtttgtttgttagtttgtaaaactacttacatattactgttattgtatatacagagaacaaacatatgttagaattttgagcttttctcatttaatacagttgtggacattatgcttctatttggttgctggttttataaaacatacttatcctgctttatatagtgactaggtgaagtaaacgaaacatcgagactagggattgattagtactagtgtaaaagaacaacaggacaaaatatttgaaatcaggagtgttccagaaaatattagatatataatacccttacaaagctttctggatgttatatgcaaaacctctgtttgggtataacctgtgaacatcagctaaacttgaaaggatgatggagattccttgagaagcaataagagcagtattttttatcttcctggctaaattttaatttcagctcaaaatttcagtgtagcttatcatattcatgctgtttatgggaattgttatggaacttttaaagtattccatgtgttcaaaaagtatttattgagcatagtctaaacacctgaggatagtcacagtgaccatgacccttactctcaaatatcttatctaatagacaagctaacaggattgtttagactatgggatccttgagaccagggattctatcttagtcatctttttgcagcccctatgccaagcacgtaggagatgttctttaaatgttttttgaatatgtagatgaatgaatgaacaactttgactgataggtgtatgcctatcaatattggtcttcggtttttcattgaatgtggtagaaggtgagcttgataatggtgatggcaggttaggtaatggatcagattggtgaggaggcagcataatagaatacagtgggtctcagcacatattaattacctgtgaagttgttgtttttttttttttgagacagggtcttgctctgtcacccaagctggagtgcagtggtgtgatctctgcttactgcagcctcgacctcctgggctccagccattctcccacctcagcaccccctccccgaatagctgcaactacaggcatgcatcaccacacccagctaatttttgtatttttttgtagagaaggggtttcaccatgttgcccaggttggtctggaactcctgagctcaagccatctgcctgtcctggcctcccaaagtgctggggagccaccacacccggcctacctgtggagtttataattatatatataaatgcctagccgctgcttcagacccactgactcagattccataggggtggggctaagatatctatattgtattcaaagctccacttgttatgatggtacacaaccagttctgaaaacctctggtttgctcgttaagaacattgactttggaatcagacaagcccgctattaaatctcggttctatcacttagttaccatttgtcctggactactgttcattttcattgctataaaataattgtcccattttaaatatttttagctctaaaacctgaaaaagtgaaattagctgcctgtggaaggaaccacaccctggtgtcaacaggtatagtgctcaacctgtatgatttcctgcctgactttgagaactgaggtctcattccagtaacgtggctttgtaaaattaatagagattatactttggcaacagtaaaattagggttttttaaaatgtcaatggctagtacacgtttgcctttgcaaatatacacgtaaatgtcaaatggctgaagaaaaagcttcttttcttggattctatcatgggacagcatctcctaacctgtgtgtccaccttaagggctggttattcctgttcttgctcttctctcttccttactaagggtgagtggaaggcacccagaaggctgttgatgtgagtgagcataattcccatcaaaatccatatgagcttttgtgtgtgtgtgtgtgtgtttgtagaaattaacaaagtgcttctgaaatttatatggaaaagcaaatgacgtagaagagccaaaacaattttgaaaaataacagaggactggcactacctggtttcaagactcgctgtaaagctactgtaatcaagactgaggtattggcaaaaagatagacaaagattaatgaaacagaatagagtctacaattagacccatatgtatatgcccacttgatttttggcaaagatgccaaggaaattcaatagagaaaggatagtatcttcagcaaatgctgctgtaacatttagacctccaggacctgaccactgagcagtacttcctaccaccttccccctgcccctgccccttgccccgcccctcccccaccaccacttattctgtcttcaggatgttttcactgcctcagctcctctccacctctccatacctttccctttctgaagtgtcttttctctttctcttagccttttaagattatttcttgagatcccattaagtgttaacttctttcatggaacattttgtgactgtgtgttcatttatttgtttgaattatttcagcatctcaccaactctggtttgctccatgtgtgtgaaattgtgcactccaattgcatgtgaccttgtattttccatttgaaagctagtcttgtttccccaattaggtttcgtcttttcctaaaaacaaaaaataaaaataacaataactttaaaatttttactaactcaggctgattttgccctcatttcaccttataatttagcaaggctttaacttcatttatatatttatgacataactaatttatgtgttacaaatcttcattaatttacaacttactggaaatgtttataatctaggcatgatgtactttttatttaattaacagagtaattaacaaacatttttacatactttaaatgagccaaatgctgttctaagaattttacaaatctcaactaattcaatcttcataacaactctatgaagtaggtactattattatcctcattttatagatgaggaaaatgaggcacacagaggttatggcttgcccaaggtcccacagctttggtaagtggtaagccagaatttgcacccaagcagtctggctctggagtctttcctgctaaacagagtgctatagtgccttcctatttagctaggaagttaaaataaatacaaagaattatcatgtttctaattagattcttcttggatttgccttgttttacttatttgtactattatatcttagctttaatggttacagaagttaaaattaatggacacatctcttttaaaatagatttgcattttaaactagtttggaagttactttccttgtttttactctgaattaataaagtgctatattagcaagaaataaatacgttccatgcattctgttcatttcagttgctagttacattctagattgatttctaaaatctcacaaaaatatgtggccttgcttgttttgctttattttgacgatgaaatgaagttgtctcccaaataataggatagtgatagctttcaactttcttcactgttaatagaggaaatcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactggtgagacttgtttctttttcagtctgggacacattcctttcctgtagatcaatatatgccaactcagtaaaccgaagggagcattgctgtttagttttctttcatcgactatctatgtgctttcagaaaacatttaaaatataactttaaatcttgacatactgcaattttatgcttatttatgcttattttatgcttatttgtgcttatttaaatatacatttaaaaagtaattggcaaataagctctaagctatgccgtctgtctactcctttagatattcttaaatattatttttgttgtgtgctcttaaagttatacttgcagttttaactgaagttgctgtcagaaacatccacagaaatctgttgcagcatatgttgttaaaatgtggtttgcaacggtcattgtacctctctgccctccctaccaaaagcccatatgagacatttctttaaaatttggagccaagatcagcttgatcttactgaagctgctggttagctgctttgtttcaagcaggagactgtgtaacatccggtgttactctatcaggaaagtcagagttgtctctgaggctcagtcctttagattttgtcagcccttaagttagcattttgacatccttctttcagttcttattttcatttatttgttttgcattattaaaatacttcaaaaatgtaaattatttaaaatatataaataaataagtcttaataattcctttctaaaatatttttcctagattaactttttctgacatcaaaacccttatcagaaattatatgttacctatttttgagatgctgtacatgctattgtatcttcattctctgaggctagattctgtgttttcaggtttaaattataaggaaaaaaaatgtagtgaaatacgtttcttctgttcttttttcaaaacatcatttccacagtgctcccaagagcaaggtcttccaggcttttttgacctgcaggtgtctaatgtgacctgtgctgtctttcagttcagttgcaggtaggctgcttggaaggaggagaacatttctgtttagaaacatcagaatgggaaagggtgattgtaggaaagggcattctgtctttgctatcgagataaaaatatggtcaggacttaagtgatttacaatcaggctgttctgtgttctttatcattatagaagcatttcacaatataaattgaactcttaagtagctagctggtgtaaatgtcttagtagtactttattgttaagatacataatttttatgaactaataaaataaatggtcttttggaagtataatagcttcagagcctggctaccttttaaaaccttttctcccccttttatttttctttatagaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgatatagtctctggttctatagaaataatgccatggttgtccatgtaatgaaattattttggtctgttttaggtcacagtatttccccatttatataataagagttcataatttcaaactctgtctgacatgatcactttttaggtgaatatagagagctcagcatgggatatagtttcctttggtgggactttctcagcattcccaacttctccctttcctggacccactggcaaccttttctgtcttagttaaaatattggaaatgttgggctctagctgttatagtctatatctatctacactagtaataatagaggaagtgtgattatgactttccatctaattgatgggatttttcaacagtaaaaacacctagaggaaatagtttatggaccctcttagacaaatctttaaatatttattttatacatttactctttattccatataccacaggctcagggttagaaagtggtaattcacccatttcactgccccctaaagttaccaatgaattggtagcagcatgataccaagagagagtaaacctgactttgtcagtatttttcaccactgcatccctggtgtcttgaacaaactgataatcaataaatattattgaatgagggagaaagtgaataaatgatgaattgattgcattccttgaggcaacactacctaccaacttattggcaacttttggctcctggggttggtatagtctgtactcgctttgttcatgaaacaaaaacacaaatgggaaaataagccaaccaaacaacaaaaataccaagtaaaagcattgtatcatatttgggctttaagaaaactgcctgaatgaattgtgtgaatgaactctgcattagccgttaggtgaacaagtggaatagttcatcttaaccaacaggcattacattgagcttttttttggtttgtttttatgcctttttttaattaaaaaaagctcagctttattgagatataattcacataccctacaattcacccatttaaggtgtacaatggaatgtcttttagcatattcacaggtttgtacataaaatgaacttttatactaagcattttgctgagattcatttacatcagctgatatgaactgtcagtaattttcacactagccattattttatgactttaatcacttaaagcaactttttataaattttggaaataactcaagtataaggggttttacttaatatgtatttcatgatagaggaaaatgttgtatagaaaagcattatttttttctctttgtatgttgaatttgtagatcagaaaaaatggattatttttaatttttaatatttgtgggtacataatatatatatagtgggtactacagatatatgtttagtgggtactctctctctctctctctctctatatatatatatatatatgtatatatatggaatacctgagatgtttttatgcaggcatgtgatgggcaataatcacatcatggagaatggggtatccatcccctcaagcatttatcctttgtgttataaacaatccaatgatactgtcttagttattttaaaatgtacaattattttgattgtaatcatcctgttgtgctatcaaatactagaaattattatttctaatttttggacccattaacctccctcctacacacaccccactaccctttctagcctttggtaacaatccttctactctttatttccatgagtttcttttgatttttacatcccacaaataagtgagaacacgcagtgtatgtctttctgtgcctgttttatttcatttaacgtaatgacttccagttccatccacgttattgcaaatgaccggatctcattctttttcatggctgaatagtactctattgtgcataagtaccacattttttcttgttttttgagacagagtcttgctctgttgcccaggctggagtacagtagtatagtcccggctcactgcaacctctgcctcccaggttcaagcgattctcttgcctcagcctcctgagtagctggaattacaggcgcccaccatcatgcccagctattttttttgtatttttaatagcgacagggtttcaccatgttggtcaggctggtcttgaacttctgacctcaggtaatctaccctccttggcctcccaaagtgctgggattacaggtgtgagccaccgcgtctggccccacattttctttattcagtcatctattgatgaacacttaggttgcttccaaatcttggctattgtgaacagtgctgcaacaaacatgggagtgcagatatctctttgatatactggtttctcttcttttgggtatatacccagcagtgggattgctggatcatatggtaactctgtttttagttttttgaggaacctccaaacagaatagtttatttcctaataaaaatacagaacatattactaagatagttatgtttaagacttcctacagatttttcacctactaatatgtttaaatgctcatgttcgtgttttaaattcatgttctcaattcaagttcatattataaattatataaaatattcaatttttagatcttatagataaataaaatctatggagttttcaggtattatccctgattgctgtgtcttttcatctgatatgttaatggttgggtctgagcattttaaccagtgattcactgaattaggtgtagtacaataggggatataagtaaatgagttggggttatgggaactgggggcaggaatttgtggagcaatcttcagatactggagaatagagacttggcagtgtgcttaagatcagaatcctggggaaggtagctgtcagagccaggtagagagtttgaggaatccagattttataaaaattaataggcctaagtgaagtagatataattgatatgaaatgacctatttattctttgtgataaatgttattttattttttatatataaataagaaaaataccttggaattaaataaaacattttatatggattaaaagcactcaccttcccctttaaggaaggtcctactgatagctacaggaaatatcttttctaaccctttacagcaagctcgtccaacccgcagcctaggatggcttagaatgccgcccatcacaaattgtaaaccttcttaaaacatgagatttatgcacagaccttttctttttttagctcatcagctatcgttagtattagtgtattttatgtgtgaccaaagacaattcttccagtgtggcccagggaagccaaaagattggacacccctgctttataggtaaaacattttactttaaaaagtcgacactgtgagaaacttcatcaacttactatgtaaaagtcattttaaatgatatttcttacaataccaagttgattaaaatgtagtacctacccttctgaagtttacagtcaaactataggatgtatagtttttccatgtacaaagcattttcaagtacgaatatatttcatttaatctcccaaccactctgggagagaggtggtggtatctgagattccatatatgcaggcaggtttagaacacagttttattcaaggtgatgctgcgattgagttgcagaatcagaattcgaactccagtcttccagttctaaaagcctgaacaatttctactgacatgcagtttctctccatatacaagaggaagaggaggatgtggtagcaactaataatgaccaggcactgattatgtgttctatgtgcctttgaatgcattaattcggttattcctatgaaacaaccctatcacataggcacttttatccccatgttacaggcccagtgattgaacaacttgctcagtatgactcagtaagtggcagaatccacatgcaaacaaggcagtctgactctgtagcacatactttttgctactgtgctagaccaataactgcaatatacagcagaccatgattggtaacgtaagacatttgatagcagagtcttacgtgagaacaagaaagaaaaaatattatttcttgttaggggcgtcaggacatatttcagagaaagggtggtatttgagattaaccatgaaagatggaaacaactctgagagagacagagatgagggaagaacaatccaggcagagacaaaaacatgtgcagagatatagagacagaaaagtaaatcatgtatttggagattattgcatagttgagtttgtttagaggttgtttgtttagaggttagggatcatggatcctaaaggaatgtaaacccctgaaatgatatgctaaatttggtaggtgcatttttttttttgagctaggtctcactctgttgcccaggctggagtgcagtggcataatcacggctcactgtagcctagaccttctgggctcaagtgatcctcccacctcattcctccgagtagctaggacaaagatgcgtgccaccacactcggctaatttttgtattctttgtagagactgggtttcaccatgttgcccagactggtttcaaactcctagactcaagccatccaccagcctcggcctcccaaactgctgggattacaggcatgagccatcacaccctgctgggatgtgtactttttttatagagctgtcatcaaattcccaagggaggatgtgactcaaaagagagtcaccaggttggggagtagatagaaatatgactggttagtagtccgggaacctaatatggaaggtctcttgtaacagtctgcagtttgtacttgatacatgtattttttttttatttggaagtgtcataattagagccttgtttttggaagatgcatctgatattgtgtgggtatgttagactagaggtaggaaagacatttggaaaacttgatccaggtgaaaattcatgttaaggtgtaaagggaatcaggaatctatagacagaaatggagagagactcatcaggacttaggaaccagtttcctatgggaggcaacaagcatgggaaaatggaagggtgctaacttactgggcaccacttttgtgccagtgtttgctaaatacttcatagaaaactgtggtccataaaacttcattttctgtgcagatcaattcagaaaatcaatatagctgtgtttacagtatttgagcaagttctaagtggtgcatatcttgtgcattggctgtcccacaccttcctgaagttctgtgattttctagaaggactcacagtcttcaatagcgattatacttacgaataagatttattacagcaaaggatacaaagcaaaaagaaaaagtgggaaaaagataagcatctgcagtggagtccagagaagtcaagcttgggcttcctagtactttctcttaggaaaccacacagggcatgttttcttagcagtgaactacagggacatgtgtggaatgtctctgcccagggaagcccattctgttgcttctaggggatttagggggctggtcatgtaggcacctcctgctagcaactggccacagcagctgaaactcaggaccctcaataatgaagccaggtgcacatcatcaatgttgatgtttgtgcaagcagccctgacaaacctaatctggcatagttcattgctctggtatatataacaaaatcattaatcattcacataaagaacactccaggggccaccttctcaggggttgggcaaggatcaatcatggttctctcagagacttgcaaagaataagcaagcagatctgctctgttgtctctttgcttataccaatggtgatatgttccatgtcattcttcagattggatcatatacttacacaaggtttttaaattctactttatagaactcagttaattgcatagaaatgaataagaaagttcttgctttcaagaagttcacagtcataatacagtgtgataaatgtaataaagaagcaaattaatagcgttagtatggacagggcagtgattaagtgtcaggaactccttggtaagagtctttggaggaagtgccatctaaatgggtaaaatctgctatcttaagatttacttaacatatttactgcacacataagtgagttttctaaaaccagtttcatataaagcaattattcattcatttattccacaaatattaagtgcttgttctagacactgctaggttttggggataccatagggagcaagacaaaattcatgtttttatgggagctttaagtaagtaaaagacacaagatattcttcacttttgtgaaagcactaaagtaattttctagttgtttattagtagtggtagtcatgaatttttcatgaaaatgattggattaaaataatcaaggggaaaagaaaatctagctttatttctttatcatacagtaaaaatatctcaagaaaggtcaaatgtattaagtgatccttgtcaaaacttttttttgacggtaagaccagctttttgttcatatgtatgtcatcactaatcactatacttttccttcaatagcagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacgggtatgtgtggagtccactgttctgttccctgcgttctgtggtggctaatgaaatttttttaatgttcattttttttatgttcatttttttattgtggtaagaatactatgagaactaccttcttaatagatttttaagagtataataaagtatttttatgtataggcacgaccattgtacagcagatctctgaaacttatcttgagtaactgaaacttcacgcccactgtacggcaactcgtctttccggcctcccctcaattcctggcgaccaccattttattattagcctctatgagtttgactcttagatacctcgtgtcaggtggcctttgcatctctttccattaagattctcactttttggacctggtgcaatggctgacacctgtaatcctagcattttgggaggccaggagatctcttgagcccaggagttcgagaccagcctgagcaacatgacgaaaccccatctttactaatattagccaggtgtggtctcaggtattcaggaggctgaggtgggaggatcacctgagccaggggaggttgagcttgaggtgagctgtgattgtcccactgcactcaagcctgggcaacagagcaagacctcgtctcaaaacaaaaagaaaaacaaacaaaaaaaagattctcaccctttattcctgtacttaatatacatttctggtctatggaatattttttttaagtagaaaaaaaatgaatcttgttgaattgtttctgctaacataatttacattttcatgaccttaactgtttttttttgagacggagtttcgctcttgtcatgtaggctgcagtgcaatggcctgatcttggctcactgcagcctctgcctcctgagttcaagcgattctcctgcctcagcctcctgagtagctgggattacaggtgcccactaccatgcccagctaatttttgtatttttagtagtgatggggtttcgccatgttggcaaggctggtctcaaactcctgacctcaggtgattcaccagcctcggcctcccaaagtgctgggattacaggcgtgagccaccacacctggcctgaccttaacatttttaatggcaacatattacattatttttagctcattttcagggacaaacaatttttctcatgtatatgttttctatatttatctaaaattgacatttttcctgaaatgccttcttttggagaagctttttgttcaagctattttctatatgtcattgataattcttttctttgtgacatttacaatgtgtagcttggggatttctttgtagttgtatgttctgttatagtaattcattaaaaagtggtatggttttaaattacagataataaaagaaagttaggaccttaatgttacttttgggatctgaatttcatatttgttatgacatgtcatttctcaggattctaatcactgtattgaaatatactcactacttgctaatatgtttactaaattgatgcttccaaattttttcaacattagatttattttagatgagtaatgtacataatacaattaggtagtgaattattattatattttttgcacaaaaaaattaacagtttgtgaagtcaccacttaatctttagtagcccaaagttagaaatgttgtagacaaattttgaataatatccaattctaagatgatatgcctaatgttgccaggtaagtgaataatattttatctttatgtttttttctctgatgttacttttcctcagcttcctgttctagccccagtcgtggttattaagctttagtttctagatggaatcttttctaagttagaaataattttttttcaaaacttatactctaaatttggaaataattctgaggtttaagatgtttttgaattcctgctgaaaaagtgaattttatataatttcgaaaatattctaaaaattaaactttgaaattaatttttacacattatctgaaaattcattctataggcagaaatgcaactttatgtgttatatattttctctagtttatacaaagactatagaaagaattaatttaataggtcattcagggttattttaacagatacaaatgttgattgtataatagtgtctttaaccattcattataaaacatttttctataaagagcaacaagataatctatgatacttttaatgaaagctcaattcttaattttaaattcttaatttaaaataaatgcacttaaggatgatattttcgtgtggttttaaagacatttaactttctgtggactttgttctgagcttaagtataatgtttccagaaattgattgctctctccagatttttgcaagcttacggatctcacacaccagtaaagttttttaaattatgagatgcatctatttgacagacctggaacagttattttttgccactaagatttctactacagatgcaagaaagaagtgtccttgcatttcctttctgattgtggcagccaacattgaatgggggaatacaggagaaaaacttggtaatacagggaaaaaaacatggagagataatttttacagttcataaataactttgtaaacagtgaagagcttgtgttacaatccagagaataatctaaaatttgagtttaaaaaattatgagaaccaatagatggttgtcagcttctgattcacgtttgcttaaatatgggcattgaaaaacatgactgcactatcatatcataaaataaggaacattttcaaaataaaaaactcttaattgtatataataaagggcacctccttaaactgtataaatgtatatgtatgaaaatttcactactttgcctgtttttcacatttctccatggacctgtgagagctttattatgagccagccctggtgaggaacctggttctggagcacagtataggcagaattttaaaaatatttagtcctagctgatgaagaaatggacctgaagagtatattgatcatcagtgtgactaaatactaaactggattgctaagagagttatggaatattttgtaagaccttaaggaaagaatagctaatcacctgttccaatttctttcactaaagaaaagcacttggattaggtgtttctgtgaaggaccttcccagccttgtttttcaaaagtctataactcttatcttaaaaatctattagaggatcattcattaaactattttaaaaacaatttagttcatttctgatgaatttatttaaaacataatatttgcacatgaccgtgatagattagaaaataaaactggttgtagtgatagggtgattatagtttctccttgggatcagggaaaccatggaccactgtggaaaaagtctgaggctggaacttgggacacactaagtgaggcagagtgatatttgtagttttgtaaatcgtccacagcagttaccaacacacaagaaaggccagttgtgagatggggttcacaatgaagtctgggtcctgaggcaaatgagaatttatcttaacttctcagattatgtttggataaacctaagttttctacaggttaacaaattattagttctgaaatcaaatatattctgtgaaattacagtaatattaatctgaagctaactgatcaaatctattttcctaatgtaatattatttattaacattaaattatgttgttaaatgtcacaaaggtgatatggccaaaaattctattggttgttaaatataatgtccttaaataagagcgccttcaatcatttttataaaatagaaactgctgtcatcactaatatccaagcacctgaatgggaacctaccaggatactgaacaaaacttctgtaacatgattcagactgcctaaacagcctcatttcacaggctaattaaaatcagacagcctaagaaatgtagagtaattgttggtcagctagagatagataattgctttaatttacccaatattctactgttaagctgaacatttagaactggaaatatgccatgtgattattatttaaactaagatggttttttaatattaaaataaagatctgttttgccattgcctcaatatggcttcatatctttgatacagcatattttcttaaaggagtagtatctatatgtcttatttatgaagcaaacatttttattagaaaaaattgtaaaaccacatgacaatagacagttatgttttcatttgtaacccccattgatagaatgagttgattagatactttttagaaaaatgttctttacaacagtatgtcatattatgttttcaaatctgcctgaatgttttctcttttaatcctgtcagcacctctgttagatagggattataacatcagagaatctaagtaactcacctgcttgccacagctagtaataatgaatgtttgggttctggcctgaataacaagctcttgcccttcctgctgtaataggagaaactcaatgtactaaactcaaagtacaaaactcagtgtactaaggagaagtgactaatataatcgacactgcgcttcctaatgcagcagccaggagcatgatgtctctaaaaggaccctttcatcaccactcatgtatcctgtttttgtactttttcatttctagaaaacatatgacgtagtatttactgagttactggaagtcctttggaatcacttcaaaatatcaatataaagaaaagcttttcccctcctattatagttgcatttcctagtgaagaagctttacttgtgaataaatctagcatatgccctatcagttttaattctcaagacaattctctgaaattgggttttataagatagattattaaactacttttattttattttattttattttattttattttattttattttattttatttttgagatggagtcttgctctgttgcccaggctggagtgcagtggcgtgatcttggctcactgcaacctccacctcctgggttcaagcgattctcctgcctcagcctccctagtagctgggattacaggtgtacgccaccatgcctggctaatttttgtatttttagtagagacagggtttcaccacgttggccagactcttctccaactcctgaccttaggtgatgcataaactgcttttaaaaggaagaagtttttctgtaggagacactattcacttttttatttgacgtagtgagttagcttaatgacagttggttcttttttattttttgagatggagtgtcgctctgtcacccaggctggagtgcagtggtgcaatcttggcccactgcaacctctgccacctgggttcaagcgattcttgtgcctcagcctccctatgtagctggaattacagatgcatgccatcatgctcaactaatttttgtaattttagtagagatggggtttcaccatgttggccaggccagtctcaaacctggcctcaagcagtccacccgcctcgtcctcccaaagtgctgggattacaggtgtgagccgttgcgaccggccaacagttggtactttttgagccgacgtaattatggggacatttcaggtagttccctgacttatgtgccttgtatcatacctgttacttacctaactatggttatgtataaaagataaaatcatacccatgtcataatttttataatgatgtaccttttcatttttctcttccttcatcattgaaagatttatacttcaatattaagtattcttaaatgtttttttttccccagaggcacttaaccttcactataaaaggttgaacgtgacagtttttccagatatgatggtaacagtgtctgcttccataatccttgtcttgtatttgcccctttcctttcagagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacaggtatggattagaatttctgttatatatttatagaactgggtatattttattacaaaataaattatatgtgaaatgaatgtatctaacttaagtaaaggaattaatggctgagaaaaatggaattccatgtttactattccaaagtataaagttgtgaactttttattattttaattcaatttagaataaatgtaaatgatccaaagatttagaacctcacaataggccgatgatgtcagaagttagaccatagtattattctttgtcagaaaacaggaatctttttgaaattatatcattttgaaggctcttaattctactcaggccaaaaggaaaaatcccacaagcaaaaacttattttaaaacattcttcctattcagtctgacagagctgcattcaggccgagtcagttgttatgtttttgccacctggaggcgttttcaggaatgactcctttccttctctttctacgtgttagagagaagggaccctcagagaccactaagtggataccttcttccactctgtggtatctccttcatgcagggaaatgttcctttgagcccacttctcagcctcaaaactatgtgctgctaataatataggactcagtaaagattctcccctaaatgattcagtcacatatatgtaggtaattgatatagtccacagttttcaatgctttgtgacaaacgggtatataatttcactatttctgtctaaatatgaagtgaagcattggaaagtcagaaatcatctagtgtattgacgtaatccatgtactagtatttctactttttttccttctttttgaaaaagctactgctatgaaaaagctcctgaaaaaactactgctcatctaatggtatctggctagggaaactaggaatcagcaaatgcaagatatactgtttcttcttccccaaagaagctttcagagaagatgacctgcccatgatcaagtatcagtgttcttgagaatgtatcatgaaatagcattatatagaatatgaaaagtattattcattcatcatccactaagagttgttgtgtatcccttaactatagggtcctaatgtcactttatctgtccttactgtcatttttcatcaactctaatcttccactaatagtagatacatactatttttaatctgtcatctaacatacaattcgaatatttagttaaattttcatagtacctttactcctgataaaaagagttatagcacaaataattgaacattaactttgtttgcctttttgttcatcaatcgtccctggagggcaagtggtgtggaattttttttttttttcctccaggactaatgagaagtatgtagtgggttatctgcaagctcttgccagttccccattatagccagtggctcatatttttaaaagctctctgaggttgaaagtgccatcaggcagcttggatcagggtttatattttcaggcaaaagacaatcaaatttaaaaggcaaaccttaaaaaacatttgggtaaagaaatcaggttgaaaagaaggaggaagaagggataaaggtgataaggagcagatataaaagaaggacataaatacttaatagtaagaattgtaagagtctacagcttggtcaacatggtgaaaccccatctctactatattcaaaaattagccagcatggcagcgcgtgcctgtaatatcagctattgaggaggctgaggcaggagaatcacttgaacccgggaggcagaggttgcagtgagctgagatcgcaccactgcactccagcctgggtgacagagcgagaccccatctcaaaaaaaaaaagaaaaaaaaaaaaaggtagtctaaagagtccaaacactgaatagcacttacttacatatttacagggaatctacttatttttgtaaatcgatttttatacttgccaccttactgaattatattattctttctgatgatttttcagttctcttggatttgcttagtatgcagtcactttgccgtcttaaaccagaagtccccaaaggtgacccagttgtttcccagcttaaaaccattcattttccttctaaatgtccttaagataaaacttcaaaaatccttcatctgaactaataggacactctgtgtagtcccttttcacctcttcagactcatctcctaccactctccccttagtgcttcaggggtattagttgcctttcagcttcttgcccgagccacgtttgctcttgattcagaggctttctatgtactgctgactctgcctggaagattctttgctcccttcttcatgcagctaagccctactcatcctttaggtttccctttgaaagccttccctaatccccagactagaggaaaattcccctcctttgaaccatattaacaccccttacttctgcttccctggcacttaccccagttgagatggagcggcttgaagaaaggagtgtgaaggttcgtaatagctgctatggcagtaagcaaaaggactaactggcgagaagtgacaagattactcatcatcattgtgggcccagtttcagaggggacccaggttttggtataggaattagttagcatttttggcttatggcatttacttcaacagtattccacagcccaggagccagattagttaagctaagccagtagtagagattttgtgcatcccccactccccaagtcacatgacaacgtttggagacattttttaatggtcatgactgcagaatggagttgtcctactggcatttagtgggtggaggccaaggatgctgctgaacatcctacagtgcacaggacagacccacacgaccatgaattatctggccccaaatgtcaataatgccaaggttgagaaactctgatctatcagtgacctcagggaaaaggaaaatagactgtgttgggatgtaggggtcagaatacaagcatctccttctccttcccttggaatatatgatgtgtatctcaaattctcattctgtattgctgctgctccacacactgccttgcgtgacaggtcatcaacttcacaaaccaccaaggttaattgatttattctcagaatatttattgcctgatgttacatgcaggaccacagagaccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttcctttttgctgaaatcttgtctcttctgcttcattctcatatatctgttgaaagctgggactgtgccatgcccgcaggctttgtatcttgtgtagcacccagcagagtaccttgctcacaatagtctttaataaatatttgctgaattaaatgttagactctcaaatcctgcacaacagaaagtctgataataaacaaagcgttttggcagggcacggtggctcactcctgtaatcccagcactttgggaggccaaggcgggcggatcacctgagatcgggagtttaagaacagcctggccaacatggtgaaaccctgtcactaatgaaaatacaaaaattagccaggtatgatggcacacgcctgtaatcccaactacttgggaggctgaggcacgagaattgcttgaacccagaaggtggaggttgcagtgagctgaggtcgtgtcactgcactccagcccaggtgacagtgagactctgtctcaaaaaaaataaaaaataaagagttttgaagatacggttttttggctaaattttcttaggttaaggatgtattatttcagtgtcacgtcaccatcacgcatcatacctgtattgtttcttaatatttttgccagttaagtttagacttttgaaaattctatttacttgatgataatactgaaatttgtcctccagagactcagtgtctcataatatggaacactttgatttattgatttgacagtcatttaatgaaagcctactatgggtaagatagtgtgctaagtataagaaatacaaagtactggtcgggcgcggtggctcacgcctgtaatcctagcactttgggaggccgaggcgtgcagatcaactgaggtcaggagttcaagaccagcctggctaacatggtgaaaccccatctctactaaaaatacaaaaattagctgggcgtggtggcaggtgcctgtaatcccagcttcttgggatcctgaggcaaaataattgcttgaatccgggaggcagaggttgcagtgagccgagattgtgccattgcactccagcctgggcgagaagagtaaaactccatctcaaaaaaaaagaaaaaaaagaaatacaaagtattgtatacagtgatgaacgaaataaccaggacctcattcattgaggacttattcattacagtcttataatttttaaaagggatatacaaaaatatatataaatttaaaattttaaagtattatgaaggaaaaatagaacattataaagtatctagaacctatgtacggaaaatactgcactatgggttttttttttagcattttcttgaaaatgatttatttctcaaaattctttgaatgctgatttcattttttattgttctgtcatcacccaagtaatcacgcatacttgcatttattttcctctaaggacttttaagcattaaacttagaaaatgttcatataaagaaggcttagagacataattagctcaagagactgatttatactttaaaaaaaatcttctagtagaacttctctgagtaatttttcacatttttaatgttcttcccagattaaaatacaacattttctaactgtaaggagaaatgtaatttgccaagtatttttttctctatattattttaaattgaaagtaaaatggtggattaaacttgttctaattttcaatcacaatgtttaaagaatatgtatggtaattgtgtacctattgtatacatattgtgtacacattctcattgtgcacacacatacgtatagacagagagattcaccaagccagtctgtctaggaagcctaccactaaataaatgtcttacagctgataactgttaaaaactcatttgtgtttgaagccaatgttgatgagtttttctgtggatttatgctgcaggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggtacaattgtggcctattctgtataatagtattatctagcactgcaaagaaaactagaagaaaaaaatctgttttctttttaaatcaaagggtcttctcagataaatttgctacataaaattattagagttgagtgctaacaaacttttagagttaattcagaaaaattcagaaaagcttaatgctttttttaaagacacaaattagaaaatttaaattatagaaaacttttgcatatagacaatggtgctataaaagcatccttttatagtcctattttatcacctcacattgaatgctgaattgttttttcaactgcatgtggactgactttcactttgttatatgcttttttttattatggtagtaaaaatacaacaaatatacccccttaacagatttttaagtgtgcaatacggtattgttgactataggcacaatgttatgttgttcagaaatctgtagaacttaattatcttatataatgctacattcttttgtctttcagttaagcctcatgagcagtgggagcttatatactataaacaatgaaatgggaaaacaaaggaataaggacttcaattagagagaggaaatattctctcaattaaatttagagattttccttctgtgttttaaaattattgttccaatgacatatatatatatgtgttttttttttttttgagacagagtctcactctgttgcccaggctggggtgcagtggcgcaatcttggctcactgcaacctccacctcctgggttcaagccattctcctgcctcagcctcccaagtagctgggactacaggcgtgcaccaccatgcccggctaatttttttgtatttttaggagagacggggtttcaccatgctggccaggctggtctcgaactcctgacctcaagtgatccaccagcctcggcctcccaacctgctgggattacaggcatgagccaccaagcccggccccaatgacatacctgttttttaaagtaaatggcaaataatttttgaaggtaacattccttttttgaaaattactataagtttcaaaacatgtttttttgaaggttcatagcagttttatttgtaatagccagcatatttcttttgaagtaaaaaggttaaatctggtgttttattatgaaaaagcatatatggaaaagttgagaaataccccatcagtgttttgtagttgttgttaatttacatctcctaagtaattttttgtttcttagggagtgtagagaaaatgcacacacacttttccctggtcatgtgaaaaataaagcttccaaattgaaatttagagcaactaagatacagagacaacagagcaaaatgtttttgagcctttggggattattaagaagtaaatgttgtggagtgttggcatactttgaactttctcttaaatattttagcaacttttaggaaagtttatatcaatattaaatatataacatcatgaaatagtttgtttaacctgcttattttaaaggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccaggtaacatttgctactctgtctgctctcaggataaatgtgccttttattcctgtagtttttatgtttatcttaagatgttttctccagttatttaaattgttctctccctggttagagcctaacatcactcatttgaactcaaatccgggaatatccttacaagtagaaagcaccatcagtgctcctaagactgccatgtaaccacagcagcatatctttatagagcagtggataacagttatagtacattccttaactttatcccctttaaaccctgaaaccacttgatgaacttaggagggagttatagtcttcattttagagatgagaaaagcaaggcttgaagagatcaagtgacttgcccaaggtcactcagcttataaacgaagtggtcagaatttgaatacaggtcttctggatctatgtgaaattctgtatttaggcagtataacatagcggttaagagcatggactatggagttaaactggggtcaaaagccagttttgacatttactagctgtgtggctgactttgggaaagttacttaacctctctaagcctcagtttccttgtctttgaaatttatttaataatactgacttcagaaagtgattgtgaggattcagtgagatcaggcatataaaataattagcattgagcccagcacctctagaaacacctcagtaaatgttgttatgattaatattaatacctttgcgtcactacctattagatacagatttcatgttttaatttgtaatcccagctctttcactattctatacctattctaagtaattttctttagagatatttgtgtatcttaggagtgtctgtatgttactgcaggacatctagagagggaatattctctcttaattaaatttagggattctcctgtgttttaaaattattgttccaatgacacatatattttttaaagtaaatggcaaataatttttttttttgagacggattctcgctttgtcgcccaagctggagtgcagtggcgcaatctgggctcactgcaagctctgcctcctgggttcaagccattctcctgcctcagtctcctgagtagctgggactacaggtgcccgccaccatgcccggctaattttttgtattttttttgtagacatgcggtttcaccgtgttagccaggatggtctcgatctcctgaccttgtgatctgcccacctcggcctcccaaagtgctgggattacaggcatgagccaccacgcccggccaatggcaaataatttttgaaggagacatttcttttctgaaaattactgtaagtttcaaaacatatttctttttttgaaggttcatagcagttttatttgtaatagccaacatatttctctatttgataggggtaggacaagaaaccaggaccaggagatcagaaagtaagcagtaaatttgaaattaagaagataaacctgtcatcagggactaagaatcagggactaggaacagataatttgtgtatctttgagatcaggaagctaggcaaagggttgaggtaataaaggattgggaactcaggtaagaattgtgggccatgggaatgggatattatatataactaggaccttgataatgagctgatttcttgcacctgacccacaacttttgtatgttttcttttgaaataagatcaatgtctaatggtactcttcagccctggacatggaaaaagtagtagattctggcaagcagtatgtagtgtgtacaaggaaaaaatacatttatggtttagggaaaattgtttctcagtcccagagatttgaatgtgaaaatatgcatgattttgtagctagatcaaaaggaaatgccatctcttgtctttttgtgactgctaacactctcttaagaaaacattttggaagttgtatctaacatatactttaactttttctaaatcattcacagacttcaatctttataatggaggaaagtggatcaggatatatcttactaaggagttgtcatttaagctaaaggataagaaagagatggctacacagggagactagatgtatttcaggcaaagaaaataatatagacaaaggtttggaggcagttaagaagaaaaggacaaccagtggggctagaaagtgagggaaagggtaagataaagcagtattggagaaagagatggtgaaaaattatttacggttttataggccgtgagagacctacgtgatatgaatgtttttcttaagtgagatagaaagtcattaaaagattttaagcagtagactgatgtgttccaatcctatttctactttgagatgattatgatcacttctacctccatatagattatacagaggccagactagaaataggaagaatacttgtgagccctttgcaggagatgatagtgtatggaccaaggtgtttgcagtggagatggagaaaagaaaaagaaaagagggaagatgtgaaatacattatagacataaaaaccaaccggacttgctaaacttattaatgcaccacacatacgtgtgaattaaagtgaggaatcaaggatgattcctaagcaagaggaagcttgacacatttgaggaagaaatttaagaactaagcctcaaactaagaacacgtttgaggaagaaatttgagatctgtgaggcatccaagtagaaatatcaagctgattgttgaaacacaagcctaaagtttagaagagagccctggactagaaatataaatttggaagccatcaacatagagatggtatttaaaagagatgggcatggtaacttatgcctataatcccagtattttgagaggctgaggtaggaggattgcttgaagctaggagtttgagaccagcctgggcaacacagcaagaccccctctctctatttaaaataataataaaatccatggatgttggtgaaatcacctgctagagggtagagtcagaagagaagagggcccagaatgtatccctaagaacatctaacatttgaggggtagagaaggaagagccagcaaagaagccttcctcagctttttcagccagtaaggcaggaggtgggaaattagggcagcgtagtgtcgtgaatgcaaagtaccgctcaaagatcaagggaaaatagctcaaagaagtatccaatggatttggtataatggagtttactggtgacctcgacaagagcagttctaggggaagatcagggaagaagccagagtgttaagagttgagttatgaatggggaatgagggattgaagaggagataagatgagcagataattcctttgtctatttgctgataaagtggagcagagaaatggtctggcagctagagggggatgtgggctcaatagaaaatattggagcacatttatatggtaatgaatgagccagtagtcctggagagagagcacagaagagagaaagtataaggaaagttgcaaagctcttgcaaaacaggaggggccggcatagagagtggtctttggtaacaggaaaaacacatcctacattttaacaggcaaatgagaacttgggtacaaatataggtagttgtgtatgtttgttggtgagaagatcaagtggatcggatatgatcacttctgttttctcagtcaaatctgaggcaaggccatcagcttaaataatctgctatgtattttccaaacctatattctctgccttctccagtctatcctgcataacactttccacattgatcttcctcaggtgcaattcagtttccatgtgctccagtgtcttcagtgaattcctaatatttatgaaaataattgttaattttcccatataattccaaattctagctttatctctcagtagtcttttccttacaatcttcatttggtaataggtagtattatggtagtaatgtattatggtagtctacaaataatggctcgtgggccaaatctagctggccacctgtttttataaataaagttttattggaacccagccatacccattcctttatgtattgtctgtggctgctttctgctacaatgtcataggttagttaggacagagaccatatggcccaggaagcctaagatgtttactatatggccgtttagagaaaaagtttgctgactcttaattttgatcagactgatctcttcagtctaacttagtggaaagaacaagagctgtggagtcagacagacctaagattgacactggataccaacggtcactgaaacttaatttctatatttacaaaatgaggatataatacttaaccttccttgttgtcgtagggtcaatataacatatataaaagcatatgtttctgggatttggtaagccttcaagacaagcttctttcctctactcatttgctgagactactgttctgctgctttattaggaatgggcttcattgtcttccccttacacctccatctctgcccctcagaattctaattctactcatctttctatgtacctctgtagtgaaacttttcctgattgccaacatacggatgtaatttctcatagactataacttcattaagaaatagcaattacaattttttaacagcaaacaacaaaattgcaattgctaatacttaatgaacttattagtatatgtatacccaaacatgttttataccttaaatatagacgataaaaaataaaaaagaattagcaattacttatgttgctattctgcagattaccacacatggaataaataccaaatagttatttgctcattcaattcagtggatttaaaggggagggatcagtgtggactgtcattttttagtgaagacttcattaaggagctacgtccaaatgtattggtgatcaatgagggcatagtgagaaactgagaaaaatgtaaagtcaagtagagcctatgacttttaattatctactttatgatgtaataaccttgcagttttctgtgaaaggttctaggtgcttatactagttatctgttgctacatttaaaaaatgaccctaaaacttagtaggttaaaacaaaaagcatttattatttcacacagtttctgagagtcaggagtccagcagcagcttagctgggtggttctggcccaggttctttcatagggttgcagtcacactgtcagatggggctgcagttatctgaaggcttgactgaggctggaagatccacttccaagctcattcacatggccattggcaggaggcctcacttccttgagatgctcacaacatggactcctacagagcaagtgattagagagaaagagagggagtgcacgagtgtagctgggggtggagggggagagagagagagcaagagagccagagcgagcacaagtgcgcatacgtgtataaccaaaacagaagccataatgctatcacaattacatctgctttattttactggctgtgcacatacggaccaacctggtataatgggcaagggaactacacaagagtatgaacaccaggacgttgtaggtcattggggcccttcttaggactagctattacagtgcttgatacctgggtagttatttatcccaagggaatagtgtttgcctgttcatatgaatgaaacaattgtaatctaattggtgtcaatgtttttaaactttcacaaagattttaaaacctatgtcattgtgaatgaattcttttcaatttccctgacatgaggttaaaggacttttagtaaaattatacctacactttatattatagaataatttctgttttctgtccagttgcctttcacttttctgttgaaatctggatttcctttttcccatttaatcattcagattatttgctagatgaaatgaccaaagaagcagagatagataattcttcaactgtagaaagccttggagaaactactgatatcttaaacatggtaatgatttcctatctatttatctaaatatgagtttgaattttagttcattgtgtatgtgaatgtgtgtatacttcctatactcttatatgcatgaaagcgtctttctcgtttcttactttattttttaaccaactatattgaggtataattcacatacaataaaatttgttttgatcctcacattattagtatggcaattgagagcggattctattactatctgaactgttttcccttcattttatatatatatatatataaaaaaatatatataattgaaaatatactatatatttgtactatatacaaatatatagtatatatactgtattctttttataatatatattttttatttatttcagacacacatcatgagcctgaattccaatgaaaagtcattaaaattatcaccagttcagaaacaaaaggtataatatgaagatttattttcgttattgttggtgagagcagtttaagttaattttttggatggtttttggaaagaacacaagaaacgtaagcatttacttactttagaatttaaaagacagagggatacaatgtagataacctccattttgccttgttctgatggtatgtattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaattccttttaagctgacatatattttatactttctatagtctttttaagtttaggccctaccaggcctactttagtaaatgagaaaagatttattatactatttctgtgtattaacttgttaatttttaacttgtcatgttttaataatttctttggcacaataggaacctcttcctaggcctaactcatcacaatttataaaatttgaattagtgaggttttactatccagagacccaaattcattagatatttgcatccattagcttgtttgtagaatttagatcaacaatttggttttgccttattttgtccagcaggaaattaattttgtattgttaatgtattattcaaatgtcagtgtttgatttcatagtttttgtacaaatcttacattttacacttaatattctttccttagtgttctttcatttatagaaattattgtaattaaataatataatcaatgcaaggaagaaggtcaaaaatttgaaaactcatgaagattttgtttagaaaagaaaaatatattcattattatttagtttatagataaaaaacatctcatgtgcagtttcttcagttctaggagtggactattcatttttttcaaattttacatttttatttattttgtgaattttgtggactcaaaagacaaatgaaaatttgaaaattaggccaggcatggtggctcatgcctgtaatcccagcactttgggcggccaagatgggcagatcacttgaggtcagaagttcgagactagcctggccatcatggtgaaacctcatctctactaaaaataaaaaagttagctggatgtggtggcatgcacccatagtcccagctactcaggaagctgaggtgggagaatcgctggaacccaggaggcagaggctgcagtgagctgagatcatgccactgagctccagcctaggtgacagaatgaaactccgtctcaagaaaaaaaaattgaaaattaaagatgatcgggaaagtgggaaaaatatactaagctgtactatgtataagaaaagtgtacatttttttctttgaaatggaatttcgctcttgttgcccaggctggagtgcagtggcacaatcttggctcactgcaacctctgcctcccgggttcaagcaattctcctgcctcagcctcccgagtagctgggattacaggcatgtgccaccactcctggctaatttttgtacttttagtagagacgggttttcaccaggttggccaggctagtcttgaactcctgaccttaggtaatccacccgcctcggcctcttaaagtactgggattacaggtgtgagccactgtgccaggccaagaagtgtacatttttaaatagcatcttgcaaaattaatctcgaagttttatgtaaggattgattcggattgagaaaagaggcagagagtaaatattgatggtattgtgattaatggcaaaattatggcaggtagtaagaatcgaaaattaaacacagatacatgttactaaatcaaaattagatgtatcacagactagagagtggcacaaatgatccttaaagaaaacaaaactttagcaaaatatctggtaaaacttgctattttgattctcctaaacttataaaaatgtaaaatcttggcagtatttaaagtagataagttgtccttgtcaactaatagtagtatgacatatgataattacttcaaaaaatttacagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgtatatagtcagaaattctttatgaaaagataaactgtctagtattagatactgaattttagagaggctagatttccactagagtaatttcaattgtcccttaaaattttccgtgtacataatgcagctaatttatctgatagtttatttgtggctcctttttcaactaatttcctttcatagtcccttttatatcctgggcatgagagatttcttatacttagttttattaaggaggattttgatgagaaacttcctgtgagttttgtgtagttgagttcttttgcacagttgattctctgagtgagaaagaatatgaggaaaaagtctagaatcgtatgaagtaaaggatttcctaggagcaattgtaagttttgccttagctgcaaggatctctggcagcttcccctaactaaccaaatgtactgatttggcattgcattgctttaccgaattcgaccacattcattaagggatagtagaaaagaattaatactatgataaaaatatatgtgccgaacatgattatttaaaaagtagatttaaaataattaagatggatgacacagaattcataaagaaaaaaacctccagggaaatgagaaactcttaaactcaagttattaatgtaatagctatgagcattcatcttctactgaagagataatcagccagtaatacagaaacaacgttctaaaatacacccatctcagtattaaacctggtctatatgtccacgtttaaatagcatttcttcacatttccctggccaaaaacattttgtgctctttagaagtggtagttcatgcaagcattgttttctagtggagaacactggcctccctagtcactttgagaccaaagcccttcttctggttttgtacttttgagctgtctgaacttgggctagtctcttagctttgcagtcctcaatttcttcatctggaaaattatagaatgagaatgagtgacctaagggattctataggaacagcagttgttcattaccagctagagctctgtcacacccagattttctgcaattcctttttcctcaataaaaaatcttaagtctcgtcaccaaagcgaccccacattcaaactaactagtagttatactaaagtaaacagttatcctaaactactaagcacacactaactttctgtgcccactgttgggcgaacatttatttaatcacatgtggcaggtctagtaccctcaaaaagtttatggagaggagtgtattgtgggttaggggtgggttggggtacaaaagacccaggtctatccaggctttcatcgacagaagtgatttacatgtttgtaaattttatatatcttaggagaaaaaaaaggaagcttaagaatgagaccactttgtccctcatgaattaacacttggttatatagattaaaataactggttccttctttattgttcccatctgctggttgttcaggcttttatagtagtttattactgatcattattgagggaagtgtgagtagtatatatagaatccattgagttacatttcctaatgaggactctggctgaaaaagactttaaggtaagctgcaaaggattacctaccacagaaactgctgctgctgctgctgctgctgctgctgaacagcagcagtcaaggtgagtgcaactgaaatgtcttctattatttcactatagagaaacttgctatacacttacatagcaaaaataaaatgtgaccatggaagaaggaaaggccaagcttttcttgtttctgacctggagaactgagtagaaagagtactattcagcaagatcgagaataagggagcagaagcatgtttgggagacagttttttactgttgattttagattgtaggagatgttcaggaggcagatacctgtatggatctggagctcacggagactgctgagtatcgccagctcatagatgtagttaaaactggatttgactgaaaggaagtgttcctaatgtgaatggaggagagttgaagacagaattcagagaaatgtcagtaggtaagggagaggttgagaaagtgaagtctgagaaggaggtgtgggagcatacttactaggaaagagagataccacccaagccaaagaaggggtttcagagaggaaggagtggtagtagctgcagagagagcctctaggaggcagcctagtagagggccaggggcagaacccacattgccaggaaagaatgagctccgggaaatctgctctgcagaggaatagaatcagaactgtgaaaattaaatatcagatatagatatttaatttttaaaatatttaattttttaagcatatttctcaatttaggaagggagatgtgtactccagagactttggttttctggggaaaagatgataaattttgttcataattaatatatacataagaatagagtgttattgatgtgagcttatgaaccaaaagaaaaatctgcaatgctttaaacattagtgaggcggagaaaaaaaacatctgtgagaacagccattattatcctcaaattaaatgagcaggtttggaaacaaacatgggctccaaagtccagtagaactgagttaaaatcccagccctccactgatgagctgtgtggacacctagaaaagttgtggtggtggtggtggtggtggttgttatttgacctttctgagtcttatttccctcatttgataaaggaagggacttttgacgattaaattacctaacacatgaaacatgttataggcactcagcaaatggtaacctgtatcactctaattatactctgtgatcacaccaaggtaggtgcaaagctacactcatgaatctccaggtcactgactgatgtgcgtgagtttagtcatgtgaacctgacttttgtttaaatgtaacataatagcaaaatataaattggcttatagaaatagatctgtgggaataaagtagattgcaataatgatcatgcttaagtataaggtggagtgaaactattacacaccatacattagtcaataaatgcccctaaatatttaaagtgtgttgaaacgctgatcacactcatgtggttagccgaaaatttaggtgtgttttctgtcactgaacatttccctctgtgtcctaaccttgttatcaaaataaataaaaataattagcacataaggtatagtcgtggatcatgcatttgtttatggacaacaagaaaatcttctaaggaaaaagagtagagatagtaaagaataaatctgaaaatgagaataaaaatgctcgccagcaagatattctatactctgaacatttatttctgtaggcctgcctatcaaactggaatgtattcagtggtgagaatacaggattaggaatgacataagggagtggtgcctagaaagaaggaagagtttaagagattataaagtagtatgatcagccaagaatttggagatcacaactggcagcccatgggtgcagtctggcctgcagacttattttgtttggtgcagtttttttttatttaaatcatattggttgccaacattgaaatgtcaggagattttacatttaaaaagtttctcagccaggcatggtgactcacacctgtaatcgcagaactttgggaggctgaggctggaggattgcttgaggccaggagttcaagaccagcctgggcaagatgataaaaacctgtctctacaaaaaaattaaaagattagttaggcatggtggtgtgcgccctgtagtcccagctactcaggaggctgaagtgggaagatcgcttgagccctgaaggtcaaggctgtagtaagctgtgattgtgccactgcactccagcttgagtgacagagtgaggccctgtctcaaataataataatgtttcttggacttttggaaagcctgggtctgggagcatcacactgtggcaacactgacctgaagctgagctgaggctggcacccctctccccagttcccatggctccttccctcactggccttgatgctaggctcctggctcacaataaaaggatgtatagaggacacaaaaataagtggacgttttaaatgaactattttccagtgataagatctgggacattatgggaaaaaaaagtccaaacttactgtttttcgacagtcctcaatgcacactaagaattctatcttactttttatggaggggcctctacaaaattatttatacttatatacaaatatatagtatatgctcatgttatttttctctgtaaataatctttttaatctttacacaaaccctctgaggtaggtattgctaatgttatttttccattttacaggtagactataaaatacattcactgggtgccatgctcaggccatgagtgattagattaaggcttggaaagcagtgcttagggctttgtatttaatgcccttcccaccccatactgctgtttccatgattttcagtgtagttaaaacatgaacttacaggttaacttttcctgtccaaaaaaaaaatatatacttgaaattttgatttttctacctgatataacttaaatacaaagttttatgctatattaacctatctgggaaacattttctaccctacatgacattgaagcatgtcagaaattctgaattatagcacaaaattttatactttatagctctggtttgttttattacttttaaaaaactataatacccacggacaaaagtgcctatctcatacatgtgtccctcaatatatttttcacaaagtgaatacacccatcacaaactgatcagcatccaaatcaaggaaaaacacagtaccagctccctcagaagcttcactttaacccctttcagtcatttcccactctcagccccaccccccagcccccatcccagcattctccttaaagcatgcgatgtaattgtgttcttaagtaaacagaaacctcagtaggaacctttgctctcttgttctgttccttaagaaatatgaaaagtgttgccttgggccagaccagagtctgcacctgactgtgccatgcctgaccaatgaaacaaagggtccttttgtgagaggtcaggcccattcacttctttactgtgatcctaacgcaagacacagacatatactgaccatttcagactacctgtttacatcttcttagatggttctagtgccaagaatgtacttaaactttactctttctttttataaaatgacagtattctgccagtcactcccaaattgtttcagtttaaaaggtaagtgctttctgtgacttcaagtagtcgtccagatgtgtttagaataattttaaatgtgcttagtctgtgagtgctatgatgtgatttctagtgaaaatgtcattttctaatagctttctcaaatttagaaaatgatatagttccaaaagttcttcattgttatagattgtttaaagttaatgagtaaaattgtagtttgttatgagtgttttacttatttctaaaataaggtaaaactcccacgtgtctttttataatagcatgacattatcctgtggttacatgaatacctcagttaacaagcccagttggagttgacccaggtgctaggttagccaagcttcccaagtaattgaggattatgctgggaacacagctcactgatccctccctctgtgaaaagaggggcatagtctgaaattccttgtctcaggagcactgttctttttagttaacctttcatttatgtatatttatgcagacaactatcagtcataagtcttaaatctagtaatcttcccattccctttcaaagtgaagttgtttctgataattttagctacccataatgtatacctggctaggcatgatacacaatataagtcactcaaaaggggaaatcaggctgggcgtggtggctcacgcttgtaatcctagcactttgggaggccaaggcgggaggatcacctgaagtcaggagtttgaggccagcctggccaacatggcgaaaccccgtctttactaaaagtacaaaaatcagctgggtgtggtggtgggtgcctgtaatcccagctactcgggaggctgaggcaggagaatcgcttcaacccgggaggtggaggttgcagtgagccaagattgtgccactgcactccagcctgggtgacagagtgagaccctgtctcaaacaaaagcaaaaaacaggcggttggaatcatgcagacaaaaacaaagcttaaaagtaaatgataactacctcatgttaaccctacccagtctaatcaatcatcatttgaaatagctgtctgccctggtaccatgttcctttctcccacattcctctcttgcatacattgcctcatgaccttggattaacctaaatctaattcttcctgagtagcttctgaaactctttttaaaatctcaaagctttatttacttagggcttcctgtcctcagtgggaatgctattaggccacgcctttgcaattggcctgaggatgacactaatgtttactattaaggtgtactgtataaacatcctcttcctagcctggactctcgcattttatatttttaccagaagaaaggtgagttaaattttagaggcattattttccaaccacctactaaagattctgttgagtatcagtcaggctttatccttagccagacagctactagaaagctgaccatcaaaagctaattacagtgttgaaggggatatggtctgaagcaaatattgccaaggtgaactttgtacaaatgttatttgaaggagtaaatggcactgataactgcttcacatattttagaagcagttataataaacttaattataataaactataaagttataactttagtgaagtgtgtaaatgaaaagtatgggggggaatctaatgagaaacctaatatcttaatgacaatcagagtatttcacccaaaattagaaagttaaaaaaaaaaaagaaatctcagtgtagaataaaggctgaaactaatattttctgcctatacttaataagcattccatgatttactatcagtctatcaaatccatagacagcctcttttatcgtttggattagctggccagtagccagacagaacaagttctgcctctgtttggttttccttctgcttttaataaccatgagcaaaccatttaaactgtctatgttcctttatcttttttcctggaatgtaaataattatacttatcttcctcatgactgtcagtgaatcgtacttctgaagtgattctaaatccctatattttggaaaatgaatataatatatagatatgattatgttataatgctacagtagacagaacgctttttaaacttttctcaaggttgaaagcattgtgagacaaccaagaaagagtatttattttttttttccattgtaaccttgccatgggtgctagtaagaattttggaaatcctagtcattgaaatagagtggcatgcgtaaaatccttgttaatacagtaacttgatattcagcatggactgtacagtatttttttcttcggcttcaatatttgaattaatattttcctggtttttttagatgacacaaattatttatgacagcaatatcaaatccctcgttttttaacaagaaaatcttactcttctctgatggtcaattttgtcacaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaaggtatgatgatagatgcttaaatcctgagatcctgggagaaaacatatgggttctctagtttctgcagaggacagattccagttgcctttgggatcagaaatactcccatgaatacatgaatacatgaattcatgtgccataagagaaaggctttggcttatttgtgaactaagcaaactttgtctctagcacactttctagaatgctgcttggtagcattctgcctcccgcatgagtggaagtagaatggtatgggccaggatagtacaccgttgggaaattaaccaagaagttcagcactcagtccttgaaatgctgaaagtgcaaagttaggagccctggcactggtggcagaaatggggtgtgtatgtgtacacacacctgtgtatgtttacatgtgtgaatgattgaaagttggtcacagcagtatttgaagttgtgatcagttcttcaaaggtgcagtctagacaaaattatgtatagaaggaataggagaagatatcactaaggaagcaaaaatcaccctgaaagtggagctagagaagcccaaaacataatctcttccattggcagttttgactgagagtgaccttgctaggagatagtttgtaggtttgaaatcatttgtttgctaacactactctggattaacttcagaagtatggaattccgcaacccaaagtgaatgacgttgtactgattcatctttattttcattttttgaacctctcatgcagaacactgagtcataccttctagtatgaaacactctcatcattggtctgttgcaaggctcttctcatgtaaatgtattctcttttagctccattccccttcccctttttccctaacatagacaaccactgaaacatatttgtcattttatttgaatgtgtacttgtgaaacatgttttgtgtgcatacatttttaatttacaaattggtattgtggtaaaggtcattcttttgcttggttccttctttatccaagactcctttctctcactaagaaaaaaaatattctagcagttactgttttatttcagaaggagaaaatgattctgtttatagggaacatttatgaattcaggttagggtggtccttaagattatttaacatagaaatcattaaataccaatttgacattgtaaaatgttgagacaagttgtatgccaattagcgttcatgaatcttctttgaggagaattcttgagtcatacagtttttttaatcacacaattttaagctaggaggacatttgcaatcagtcagcatctaaggcccctcactttacaagagctcagcaaagtgaagtaattgtcacatgtttatgtcattagctagaggcagactctagaacctgcttaaagattcagacttaagttttctagaacagcacaaaaatattttttgttatattgctttgttattgtttatagaaagaaaaagccaacctagaggaacgggccatttgtgagtacaatgaaaacccaaaaggtatgagcacatttgataacatacatatatacatacatacatacacacatatatatgtgtatgtatgccataattgggtaattataagcttacatataagtttacatatatgctataatttttactgtcacatgatcctcataacaagctatgaaatatgtgatacagacttatctgttcttatatataaccaccacagcttcttcacatacaaatattgcattattcatggctacttatgtgtcaatgttaaggaattttttatttttttttgagacagagtttcgctcttgttgcccaggatggagtgcaatggcacgatctcagctcattgcaatctccacctcccaggttcaagtgattctcctgcctcagcctcccgagtagctgggattacaggcgtgtgccactacacctggctaatttttatatttttagtagagatgtggttttgccatattgtccaggcgagtctcaaactcctgacctcaggtgatcctcccgcctcggcctcccaaagtgctgggattacaggcatgagccaccacacccggctggtgttaaggaatttaagtagcctttttactaccttttttctctctattaaatcagtattattaaatcaagcttttgccccaaattccaatttatatctctagtgcacactgctagactccattgcccaaccaagttgggactactgggctggcctaaagccacaatggccacccagttatttacccccgagggctcagacctgagtgtcttaccgtagatactgaagagaagtcctttcccaagcctacctatcagtgtcagagagcaggtgctgtggaatagaggagactgtgattgcccttgagatctacataatctagacacaaatcatctgtgtttctgtagtatgactcccacattgtttccacaccatcacacggcagtatgattgtgttctcataaaaaaataactatctgtaatactggatatctgatctaaacttaagctgaagaatgaatagtttccttaatcctgttccttttaacttctgccataagagtagtaagttttagaatattttaggcaagtgttaaaaaatgtatcacctataagtattcttaacatatagcctaaagcactacaaagaaattaaatataagcttaaaagtagttgataatataaaattaaaacaatgcatatgcttcacaagtatactttgaagataattattcagatatagaacatgtggattaatttgaaacaccaaaaaatagcatgtccatttgagtacaaagaatgtaattataactaggttaatttttaaagtaatttgtattttacagaagtcttctctaacattgactattacctttgtagctatatttggatactggtcatctaaacatttacaactttggtgaggtcattctgggcttttcactttaactcaacttttcaggaaatatgcagtgtagatgttgtccactactccaggggtgagctcttttcgtattaccccacaactcagggttcatagagtttcactgagagcatcaggtcttgtctttttcctattagttaaaactagtatttctgaatgatccaattgtaggatacatgcttgatgatgcagatagcagttcattagaaatcctagaaaacagtgaaacaacaccaagcaaagacatgaaaaaaacaaagaaggtaagtgaaatgaattgtcttttttgatccttttgaattcaattgtttgttttacttttcatatggcaatccacataatttaactctcttaatatgagttttcatggccccaaaacctgaagaatttcaggtgatgtcgcatatttttaatatactacctttcctttggttagcatttgaatgatgatcttcttttcatccttttactttagcttatgttttagatgtgtctcttgtaaatggcctatacagctggattttgtctttgacatttttaacatgcatacctaaaatctaaagctcatcaatgttcctatctttttcccaaataatgccaggaccttagaagaattttcttgcctatcacctcttctttcttattttagaagttatggtacccagtatttaaaattttttaacatcacaaatcgtatgtttttagtattttttatactacttttttactcagatgtcccctctggaattcttattcttcctgaagaaatattttggaagttcctatcacagatgtctgttgacagttaaaacttttagtttctgttcacttgaaaatgtctttattttaccatagttcttgaatgatagtgtggctcgttgacagttattttctcttagtatctgctcccattattgctgtctataattttgctttagtataattgctgataactttgtatataacctgccatttctctatggctgctttttagattgtctttggtgtgtttcagttcactatgagatgcttaagtatggatttttttttttttttgagatggagtttcgctcttgttgcccaggctggagtgcaatggcgcgatcttggctcaccacaatcctgcctcccaggttcaagcgattctcctgcctcagcctcccaagtagctgagattacaggcatgtgccaccatgcctggctgattttgtacttttagtagagacggggtttctccatgttggtcaggctggtctcaaactcctgacctcaggtgatccgcctgtcttggcctcccaaagtgctgggattacaggcgtgagccaccatgcccagcaggtatggaatttttaattttaacttacttggaatttattatgactcttgaatctgagaattcatgtcatttgtcaatttttttaaaattctcatccattatatatttgaatattttctctcccctctttcaaattctgatataaaactttttattttatgggtacatgtcttttaatatcaccttcttgttttctatgtgtaagtgatattctgggtaatttcagggccttcatcaatttcatagtttctcttcagctgagactacttggctatttaacctacctatttaaagttttaatttcagtgataacatctttcacattttaagtgaagttgtatttttgttctttttcaaatcaatctggtcttttaaaatcagtatcttgttttatgcttactttttttattctagtcttttaatttaagcacacttagtttacattctgtatttagtaattccagtgtcatccttagcagtctaaatgtgtgttgctttggctgacttgctaatggtgattagtttccatatgtgttttgaaatttgtattgtgagttcatgtttcactggtactttttttgtggaaatcctttaaggcctctgttagagtaagtctatctatagagagtttgcattagcctttattagctctggagtgactgaaggaccactttaagttcatttctcatttaagggtagaccacaatgtttgtaggtagacttatattaagggcatagtacttagaaggtcctcacattatgtaggggtctcagttccagttcccctcattttgtgagatcaaattgtttcaaagttaaaagtctaagttatgagtcagcagatgctatttcagttcttaatgacctctgaggcttcctgttccttctttcttttttggtctacaaggatttcccttagtttttggggagattacctgcacattataaaattatattttttatacttaatcagcatttcttggtattttatagtggcagtctttttgaagttgtgtatttcttcaccatagcaggaacaggagttcttccattttaatccatagatcctttttctagattcttactttttggattatcactttttaccctagtttctccactctttaaagctagaagtaagctattattattagcaccatttttatttctggaagagccaaattttcacctggtttttgtttcctgctttttgttttggcatcttgtcaaaaccattatttgtgttaccactcttcaataatcctattttcttcctggctacattctcaaagggcctaaatcaaatgaaacttttatcaccttcatctcttctgcatacatgccctgttggccactcccttcttgatgtatttttctctcctgacttctgagctgcctagttttcccaattttgcacctacaaaccttggtcctcagttctagctcctcttctgcctgcctctcactctgctctttttgcctcttttcttatattctgttttctacctgcctggaatctctgggttatcggggctactttcatctctcagctattatctatattctacatatctgcagccccagcctcccctgagcagcagctctgtatatttgactgcctactcagacccacacacagggctcacacagccatcatttggcagcactgacttttttttttttttttttggggacagagtctcgctctgtcgcccaagctggagtgcagtggcgcgatcttggctcactgcaagctccgcctcccgggttcacgccattctcctgcctcagcctcccaagtagctgggactacaggtgcctgccaccacgcccggctaatttttttttttttttgtatttgtagtagagacagggtttcactgtgttagccagaacagtctcgatctcctgaccttgtgatctgcccgcctcggcctcccaaagtgctgggattacaggcatgggctaccgcgcctggccaagcagcattaacttttttgccagaagttctcatctacaggaatggggaggtacatcgtccttcttcagaatattacaatagaaattcactgtagctgcgatacactgagaatcacagacatgtcctgaaaatgacccctcctggatacatttaaaagttacaataggtaactttaaataggtttttatatattttttctcttacaacttaacaaagtgaaacattaaatttgttctttgaagaaaaagatatcaccaaggtgttgatggtgttgaatgttagaccctgagaggtcttgttttagggtggaatcctgactgccttttggtgaaaggaaaaactctaacagatgctaagaatgcaccatagtacatgtggtgccccataaagagatgacaaaatcatgttcttacgtgttgaaaatgatatcccctaaatactgttaagtgaatgtttcacttatggaaatgaatatttgtgtgtgtggtttttttcctagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaa

SEQ ID NO: 5640 - DNA, 58211 bp, human
aagctccgcccccgttgcccgtagcggctgtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccggtgagttgcgcccgcgccggtggcggaaggccgggagggagggtccgcgggcggccgggccccgcctccggatcggccctgtagggggacaggccccaggcttggcagccggactggggcgggatcgctggttgcgctcccgcgaatgactgagggcagaggaccggacgggaagaacaggatgggggagaacgggaaagagggtgcctgtctttcgtatgctttttaaataagctcttgatgagcttcttgaaggcagggacactttttttttttttttatgagacggagtttcactcttgttgcccaggctggagtgcaatggcgcaatctcggctcaccgcaacctccgcatcccgggttcaggcgattctcctgccttagcctccgagtagctgcgattacaggcatgcgccaccacgcccggctaattttatatttttagtagagacggggttcctccatgttggtcaggctgatctcgaactcccgacctcaggtgatcagcccacctcggcctcccaaattgctgggattacagtcgtgagccaccgcgcccggccagggagggacactttctgtaaactccccaaagtgcggactccagacttgtgcactttggaggtcctgagctcccggttatgtattgaatgcagtaaagagtgagtgatcagggctgtggggtaaaaggggatacaggaaataaattggacaaagagggagaagagggaccctttagcgagtgttttttagccttttttttcctgagctccatagttagaaatacttttgacattgtgacccgatactccatatataccgtgtaacagaaatagatgtctggtgaagcagtccttgttctatccacttagattccacacacacctttttgataatgcattcttttaaaatgctgatcgtgatccactgaattgattttctggcccactaataggtcacgaccattttgaaaaaacactgggtttgagcagaatcataccttcactgaaatatgtatgttttcttccatgctcctggccggaactgacattcctggcctgcagttcacaatttagtgagacatacaggaaagtaaacaaaatgaccatataaattgacagtagatattacagggccagagcagagccaccaaaccttggcttgggatgagggtatcagggaagccaggggagccaagacaaaacagttaaaatgttaaagtaattcattctggggaaactcagagtctgttctagatcctagtctcccaactcaattattagttggaactgagatgcctcacagtggttctcaaaaagttgtccacagtggctagtctcttgcgtattaatatttattattaatacttatattcgctatgttttcctttctggtacgaattagtttatgtgtgatcacccaccttgggatttccccaaaagctggacctggcctactatttggtgtatgtgtgtgtttaaatggttattgggaaatggtaggggtttttagtctttcttcaaaatgacgctgtgccacaacagtttgtgaatactactcagatcaggtaatgacttgatgtaagaatgttaaaatctcaacatccccatgtactcctctcccaatctcctaggaccgtggcattttgtgatgatgttttggggggaaagataaaccgtcctttcccatgtactgtttctggaaagagaaaaagacatctctataactaactatagtgcatgagtaagatgagaattagaaacttcctgagtagctgtgttgagaggatcttttcattttataactggatccctaaacattctgaattctcagaaatcaggaaaagctaaagtgctcctttgttgacgacttggtaacctgtcttttatattaacaatgttgaaagttatatttgactacaaactctccattatgatgaattggtaaacaaaacattcaacagttacgaatatacatgtgtgtaagggggaccttttctgtgtgaaaagtagaacacacaagggctactttgtgctaggcaatatgggtagtgcataccctctgtaaccttagaaaatagttggaaaaaaacaacatttggggtaacaaatggtgaactctgtgtttcaacacagaaaagcagtgactttttttttttttttttttgagacggagtcacagtcacactgtcgcccaggcttgagtgcaatgatgctatcttggctcactgcaacctccgcctctggggttcatgcaattgtcctgcctcagccccccgagtagctgggattacaggcgcccaccaccacgcccggctaatttttgcatttttagtcgacacggggtttcaccacgttggccaggctggtctcgaactcctgacctcaaatgatccacctgcctcggcctcccaaagtgctgtgattacaggcgtgagccaccactcccggccgacatttttaaagtatagctttttattgctttgtgatgacctcatcttacatattgtgctacctaccaatctctctaatcaaactgttacacaaatcttgctgatttgtgtaacagtttgattagagagattgctaggtagcacaattatttgccatataaattctacagatcacgtagttcagagaagccagtgatcatttccaactcttatggtagaggaagagtttacagaggtagctattgagctaacactttgaggatgctaggctctgggctaagttctttatacatgtcatctcatttaatccttacaacaacctttgaatacctaattgcctttaaagcctatggttttttttctagctgctttcccttagttcgaatgaaagagatagtggtggagtaatttgtttctctctgtgctgtctccggttttatgggtattcattgggattaccaacagagaaattaagagttcaccattttggccgggtgtcatggttcacgcctgcaatcccagcacttagggaggccgaggcaggagcccaggagtttgagacctgagcctgagaccaggagtttgagaccagcctgaacaacatgctaaaacccagtctgtgcaaaaattacaaaatttagctggacatggtggcacacgcctatagtcctagctactccagaggctgaggcgggaggattgcttgggcccaggaggtcgaggcagcagttagccgtgattgtgccactgcgcttcaagctgggtgacagagtgagaccctgtctcaacaaaaataaaaagagttcaccatttgggctaacattgtttcccttacatgagaacactggaggttccttggaaaaactggaccaaagaaaatccaaattgactgatagagactctccccatggatagcctgatgatgttaatgaggaaacgaaatactgtcctgtttctgtgtgtggagaaaagctctcagtcagaggccagaccatgaggtgttaactagaacaagaatagcacagattgtgccatttcattccagggaatagacatctacttggtgacagcagaactattagtaatagatgactgccttccttgtgatagtatatttcttactttataccagtatatgagtaatacatgttcaatttagtagatttcatagataaaactagaatggagtctgaggaataagaaagactgaattaaggtggaagaaggaaggcttaaacattgccagagtgggggcaaagctgtcatgagacaaggggtttgtatggataaattactcaaaagttattttaataacaggcaacatagtaaaagttataaaataaagaccgtcttatatttgcagattcgggtgctgtgtttacatttgggaaaagtaaatttgctgaaaataatcccggtaaattctggtttaaaaatgatgtccctgtacatctttcatgtggagatgaacattctgctgttgttaccggttagtattacaatcctgaataaggacagtaatacttagaaaattctaaatattttgttatagatatgctgctgtgttttaaacatgttgaaaatattatcaaaagtgttgttttttactttgctggagaattcttcacaaaataagtcatcaagagcatcttttaaattttaagtttccttagtatatttaagtatgattttctatacacacaactttcttggaatgaatctatttcaatataattttttaaaaaaacctgttaccgtataattttagaaactcttttccacctaatagaaactggttatacatagatgaacaaggtaacttatttcaacacagaaaagcagtgacattttaaaagtatagctttttattgctttgtggtgacctcatcttacattatgtgaaaaatgcttcaattgattatttctttttccctcctaccaggaaataataaactttacatgtttggcagtaacaactggggtcagttaggattaggatcaaagtcagccatcagcaagccaacatgtgtcaaaggtttgggatctttttatcttttcacaaactgtataaagtatttttatgttgactgtgtagttctttaatgtcataaataataaagcttttagttctttattttctgacatttgcttgaatattattagcatttaacttatcttttatatgatattcagaactgcttttatatgttagggtctaaaaatcagattgattttaaatccagggaccacaaaggaagtaatgattttacagtattgcatttgaatatcccccatctttttttgtttgtttgttagtttgtaaaactacttacatattactgttattgtatatacagagaacaaacatatgttagaattttgagcttttctcatttaatacagttgtggacattatgcttctatttggttgctggttttataaaacatacttatcctgctttatatagtgactaggtgaagtaaacgaaacatcgagactagggattgattagtactagtgtaaaagaacaacaggacaaaatatttgaaatcaggagtgttccagaaaatattagatatataatacccttacaaagctttctggatgttatatgcaaaacctctgtttgggtataacctgtgaacatcagctaaacttgaaaggatgatggagattccttgagaagcaataagagcagtattttttatcttcctggctaaattttaatttcagctcaaaatttcagtgtagcttatcatattcatgctgtttatgggaattgttatggaacttttaaagtattccatgtgttcaaaaagtatttattgagcatagtctaaacacctgaggatagtcacagtgaccatgacccttactctcaaatatcttatctaatagacaagctaacaggattgtttagactatgggatccttgagaccagggattctatcttagtcatctttttgcagcccctatgccaagcacgtaggagatgttctttaaatgttttttgaatatgtagatgaatgaatgaacaactttgactgataggtgtatgcctatcaatattggtcttcggtttttcattgaatgtggtagaaggtgagcttgataatggtgatggcaggttaggtaatggatcagattggtgaggaggcagcataatagaatacagtgggtctcagcacatattaattacctgtgaagttgttgtttttttttttttgagacagggtcttgctctgtcacccaagctggagtgcagtggtgtgatctctgcttactgcagcctcgacctcctgggctccagccattctcccacctcagcaccccctccccgaatagctgcaactacaggcatgcatcaccacacccagctaatttttgtatttttttgtagagaaggggtttcaccatgttgcccaggttggtctggaactcctgagctcaagccatctgcctgtcctggcctcccaaagtgctggggagccaccacacccggcctacctgtggagtttataattatatatataaatgcctagccgctgcttcagacccactgactcagattccataggggtggggctaagatatctatattgtattcaaagctccacttgttatgatggtacacaaccagttctgaaaacctctggtttgctcgttaagaacattgactttggaatcagacaagcccgctattaaatctcggttctatcacttagttaccatttgtcctggactactgttcattttcattgctataaaataattgtcccattttaaatatttttagctctaaaacctgaaaaagtgaaattagctgcctgtggaaggaaccacaccctggtgtcaacaggtatagtgctcaacctgtatgatttcctgcctgactttgagaactgaggtctcattccagtaacgtggctttgtaaaattaatagagattatactttggcaacagtaaaattagggttttttaaaatgtcaatggctagtacacgtttgcctttgcaaatatacacgtaaatgtcaaatggctgaagaaaaagcttcttttcttggattctatcatgggacagcatctcctaacctgtgtgtccaccttaagggctggttattcctgttcttgctcttctctcttccttactaagggtgagtggaaggcacccagaaggctgttgatgtgagtgagcataattcccatcaaaatccatatgagcttttgtgtgtgtgtgtgtgtgtttgtagaaattaacaaagtgcttctgaaatttatatggaaaagcaaatgacgtagaagagccaaaacaattttgaaaaataacagaggactggcactacctggtttcaagactcgctgtaaagctactgtaatcaagactgaggtattggcaaaaagatagacaaagattaatgaaacagaatagagtctacaattagacccatatgtatatgcccacttgatttttggcaaagatgccaaggaaattcaatagagaaaggatagtatcttcagcaaatgctgctgtaacatttagacctccaggacctgaccactgagcagtacttcctaccaccttccccctgcccctgccccttgccccgcccctcccccaccaccacttattctgtcttcaggatgttttcactgcctcagctcctctccacctctccatacctttccctttctgaagtgtcttttctctttctcttagccttttaagattatttcttgagatcccattaagtgttaacttctttcatggaacattttgtgactgtgtgttcatttatttgtttgaattatttcagcatctcaccaactctggtttgctccatgtgtgtgaaattgtgcactccaattgcatgtgaccttgtattttccatttgaaagctagtcttgtttccccaattaggtttcgtcttttcctaaaaacaaaaaataaaaataacaataactttaaaatttttactaactcaggctgattttgccctcatttcaccttataatttagcaaggctttaacttcatttatatatttatgacataactaatttatgtgttacaaatcttcattaatttacaacttactggaaatgtttataatctaggcatgatgtactttttatttaattaacagagtaattaacaaacatttttacatactttaaatgagccaaatgctgttctaagaattttacaaatctcaactaattcaatcttcataacaactctatgaagtaggtactattattatcctcattttatagatgaggaaaatgaggcacacagaggttatggcttgcccaaggtcccacagctttggtaagtggtaagccagaatttgcacccaagcagtctggctctggagtctttcctgctaaacagagtgctatagtgccttcctatttagctaggaagttaaaataaatacaaagaattatcatgtttctaattagattcttcttggatttgccttgttttacttatttgtactattatatcttagctttaatggttacagaagttaaaattaatggacacatctcttttaaaatagatttgcattttaaactagtttggaagttactttccttgtttttactctgaattaataaagtgctatattagcaagaaataaatacgttccatgcattctgttcatttcagttgctagttacattctagattgatttctaaaatctcacaaaaatatgtggccttgcttgttttgctttattttgacgatgaaatgaagttgtctcccaaataataggatagtgatagctttcaactttcttcactgttaatagaggaaatcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactggtgagacttgtttctttttcagtctgggacacattcctttcctgtagatcaatatatgccaactcagtaaaccgaagggagcattgctgtttagttttctttcatcgactatctatgtgctttcagaaaacatttaaaatataactttaaatcttgacatactgcaattttatgcttatttatgcttattttatgcttatttgtgcttatttaaatatacatttaaaaagtaattggcaaataagctctaagctatgccgtctgtctactcctttagatattcttaaatattatttttgttgtgtgctcttaaagttatacttgcagttttaactgaagttgctgtcagaaacatccacagaaatctgttgcagcatatgttgttaaaatgtggtttgcaacggtcattgtacctctctgccctccctaccaaaagcccatatgagacatttctttaaaatttggagccaagatcagcttgatcttactgaagctgctggttagctgctttgtttcaagcaggagactgtgtaacatccggtgttactctatcaggaaagtcagagttgtctctgaggctcagtcctttagattttgtcagcccttaagttagcattttgacatccttctttcagttcttattttcatttatttgttttgcattattaaaatacttcaaaaatgtaaattatttaaaatatataaataaataagtcttaataattcctttctaaaatatttttcctagattaactttttctgacatcaaaacccttatcagaaattatatgttacctatttttgagatgctgtacatgctattgtatcttcattctctgaggctagattctgtgttttcaggtttaaattataaggaaaaaaaatgtagtgaaatacgtttcttctgttcttttttcaaaacatcatttccacagtgctcccaagagcaaggtcttccaggcttttttgacctgcaggtgtctaatgtgacctgtgctgtctttcagttcagttgcaggtaggctgcttggaaggaggagaacatttctgtttagaaacatcagaatgggaaagggtgattgtaggaaagggcattctgtctttgctatcgagataaaaatatggtcaggacttaagtgatttacaatcaggctgttctgtgttctttatcattatagaagcatttcacaatataaattgaactcttaagtagctagctggtgtaaatgtcttagtagtactttattgttaagatacataatttttatgaactaataaaataaatggtcttttggaagtataatagcttcagagcctggctaccttttaaaaccttttctcccccttttatttttctttatagaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgatatagtctctggttctatagaaataatgccatggttgtccatgtaatgaaattattttggtctgttttaggtcacagtatttccccatttatataataagagttcataatttcaaactctgtctgacatgatcactttttaggtgaatatagagagctcagcatgggatatagtttcctttggtgggactttctcagcattcccaacttctccctttcctggacccactggcaaccttttctgtcttagttaaaatattggaaatgttgggctctagctgttatagtctatatctatctacactagtaataatagaggaagtgtgattatgactttccatctaattgatgggatttttcaacagtaaaaacacctagaggaaatagtttatggaccctcttagacaaatctttaaatatttattttatacatttactctttattccatataccacaggctcagggttagaaagtggtaattcacccatttcactgccccctaaagttaccaatgaattggtagcagcatgataccaagagagagtaaacctgactttgtcagtatttttcaccactgcatccctggtgtcttgaacaaactgataatcaataaatattattgaatgagggagaaagtgaataaatgatgaattgattgcattccttgaggcaacactacctaccaacttattggcaacttttggctcctggggttggtatagtctgtactcgctttgttcatgaaacaaaaacacaaatgggaaaataagccaaccaaacaacaaaaataccaagtaaaagcattgtatcatatttgggctttaagaaaactgcctgaatgaattgtgtgaatgaactctgcattagccgttaggtgaacaagtggaatagttcatcttaaccaacaggcattacattgagcttttttttggtttgtttttatgcctttttttaattaaaaaaagctcagctttattgagatataattcacataccctacaattcacccatttaaggtgtacaatggaatgtcttttagcatattcacaggtttgtacataaaatgaacttttatactaagcattttgctgagattcatttacatcagctgatatgaactgtcagtaattttcacactagccattattttatgactttaatcacttaaagcaactttttataaattttggaaataactcaagtataaggggttttacttaatatgtatttcatgatagaggaaaatgttgtatagaaaagcattatttttttctctttgtatgttgaatttgtagatcagaaaaaatggattatttttaatttttaatatttgtgggtacataatatatatatagtgggtactacagatatatgtttagtgggtactctctctctctctctctctctatatatatatatatatatgtatatatatggaatacctgagatgtttttatgcaggcatgtgatgggcaataatcacatcatggagaatggggtatccatcccctcaagcatttatcctttgtgttataaacaatccaatgatactgtcttagttattttaaaatgtacaattattttgattgtaatcatcctgttgtgctatcaaatactagaaattattatttctaatttttggacccattaacctccctcctacacacaccccactaccctttctagcctttggtaacaatccttctactctttatttccatgagtttcttttgatttttacatcccacaaataagtgagaacacgcagtgtatgtctttctgtgcctgttttatttcatttaacgtaatgacttccagttccatccacgttattgcaaatgaccggatctcattctttttcatggctgaatagtactctattgtgcataagtaccacattttttcttgttttttgagacagagtcttgctctgttgcccaggctggagtacagtagtatagtcccggctcactgcaacctctgcctcccaggttcaagcgattctcttgcctcagcctcctgagtagctggaattacaggcgcccaccatcatgcccagctattttttttgtatttttaatagcgacagggtttcaccatgttggtcaggctggtcttgaacttctgacctcaggtaatctaccctccttggcctcccaaagtgctgggattacaggtgtgagccaccgcgtctggccccacattttctttattcagtcatctattgatgaacacttaggttgcttccaaatcttggctattgtgaacagtgctgcaacaaacatgggagtgcagatatctctttgatatactggtttctcttcttttgggtatatacccagcagtgggattgctggatcatatggtaactctgtttttagttttttgaggaacctccaaacagaatagtttatttcctaataaaaatacagaacatattactaagatagttatgtttaagacttcctacagatttttcacctactaatatgtttaaatgctcatgttcgtgttttaaattcatgttctcaattcaagttcatattataaattatataaaatattcaatttttagatcttatagataaataaaatctatggagttttcaggtattatccctgattgctgtgtcttttcatctgatatgttaatggttgggtctgagcattttaaccagtgattcactgaattaggtgtagtacaataggggatataagtaaatgagttggggttatgggaactgggggcaggaatttgtggagcaatcttcagatactggagaatagagacttggcagtgtgcttaagatcagaatcctggggaaggtagctgtcagagccaggtagagagtttgaggaatccagattttataaaaattaataggcctaagtgaagtagatataattgatatgaaatgacctatttattctttgtgataaatgttattttattttttatatataaataagaaaaataccttggaattaaataaaacattttatatggattaaaagcactcaccttcccctttaaggaaggtcctactgatagctacaggaaatatcttttctaaccctttacagcaagctcgtccaacccgcagcctaggatggcttagaatgccgcccatcacaaattgtaaaccttcttaaaacatgagatttatgcacagaccttttctttttttagctcatcagctatcgttagtattagtgtattttatgtgtgaccaaagacaattcttccagtgtggcccagggaagccaaaagattggacacccctgctttataggtaaaacattttactttaaaaagtcgacactgtgagaaacttcatcaacttactatgtaaaagtcattttaaatgatatttcttacaataccaagttgattaaaatgtagtacctacccttctgaagtttacagtcaaactataggatgtatagtttttccatgtacaaagcattttcaagtacgaatatatttcatttaatctcccaaccactctgggagagaggtggtggtatctgagattccatatatgcaggcaggtttagaacacagttttattcaaggtgatgctgcgattgagttgcagaatcagaattcgaactccagtcttccagttctaaaagcctgaacaatttctactgacatgcagtttctctccatatacaagaggaagaggaggatgtggtagcaactaataatgaccaggcactgattatgtgttctatgtgcctttgaatgcattaattcggttattcctatgaaacaaccctatcacataggcacttttatccccatgttacaggcccagtgattgaacaacttgctcagtatgactcagtaagtggcagaatccacatgcaaacaaggcagtctgactctgtagcacatactttttgctactgtgctagaccaataactgcaatatacagcagaccatgattggtaacgtaagacatttgatagcagagtcttacgtgagaacaagaaagaaaaaatattatttcttgttaggggcgtcaggacatatttcagagaaagggtggtatttgagattaaccatgaaagatggaaacaactctgagagagacagagatgagggaagaacaatccaggcagagacaaaaacatgtgcagagatatagagacagaaaagtaaatcatgtatttggagattattgcatagttgagtttgtttagaggttgtttgtttagaggttagggatcatggatcctaaaggaatgtaaacccctgaaatgatatgctaaatttggtaggtgcatttttttttttgagctaggtctcactctgttgcccaggctggagtgcagtggcataatcacggctcactgtagcctagaccttctgggctcaagtgatcctcccacctcattcctccgagtagctaggacaaagatgcgtgccaccacactcggctaatttttgtattctttgtagagactgggtttcaccatgttgcccagactggtttcaaactcctagactcaagccatccaccagcctcggcctcccaaactgctgggattacaggcatgagccatcacaccctgctgggatgtgtactttttttatagagctgtcatcaaattcccaagggaggatgtgactcaaaagagagtcaccaggttggggagtagatagaaatatgactggttagtagtccgggaacctaatatggaaggtctcttgtaacagtctgcagtttgtacttgatacatgtattttttttttatttggaagtgtcataattagagccttgtttttggaagatgcatctgatattgtgtgggtatgttagactagaggtaggaaagacatttggaaaacttgatccaggtgaaaattcatgttaaggtgtaaagggaatcaggaatctatagacagaaatggagagagactcatcaggacttaggaaccagtttcctatgggaggcaacaagcatgggaaaatggaagggtgctaacttactgggcaccacttttgtgccagtgtttgctaaatacttcatagaaaactgtggtccataaaacttcattttctgtgcagatcaattcagaaaatcaatatagctgtgtttacagtatttgagcaagttctaagtggtgcatatcttgtgcattggctgtcccacaccttcctgaagttctgtgattttctagaaggactcacagtcttcaatagcgattatacttacgaataagatttattacagcaaaggatacaaagcaaaaagaaaaagtgggaaaaagataagcatctgcagtggagtccagagaagtcaagcttgggcttcctagtactttctcttaggaaaccacacagggcatgttttcttagcagtgaactacagggacatgtgtggaatgtctctgcccagggaagcccattctgttgcttctaggggatttagggggctggtcatgtaggcacctcctgctagcaactggccacagcagctgaaactcaggaccctcaataatgaagccaggtgcacatcatcaatgttgatgtttgtgcaagcagccctgacaaacctaatctggcatagttcattgctctggtatatataacaaaatcattaatcattcacataaagaacactccaggggccaccttctcaggggttgggcaaggatcaatcatggttctctcagagacttgcaaagaataagcaagcagatctgctctgttgtctctttgcttataccaatggtgatatgttccatgtcattcttcagattggatcatatacttacacaaggtttttaaattctactttatagaactcagttaattgcatagaaatgaataagaaagttcttgctttcaagaagttcacagtcataatacagtgtgataaatgtaataaagaagcaaattaatagcgttagtatggacagggcagtgattaagtgtcaggaactccttggtaagagtctttggaggaagtgccatctaaatgggtaaaatctgctatcttaagatttacttaacatatttactgcacacataagtgagttttctaaaaccagtttcatataaagcaattattcattcatttattccacaaatattaagtgcttgttctagacactgctaggttttggggataccatagggagcaagacaaaattcatgtttttatgggagctttaagtaagtaaaagacacaagatattcttcacttttgtgaaagcactaaagtaattttctagttgtttattagtagtggtagtcatgaatttttcatgaaaatgattggattaaaataatcaaggggaaaagaaaatctagctttatttctttatcatacagtaaaaatatctcaagaaaggtcaaatgtattaagtgatccttgtcaaaacttttttttgacggtaagaccagctttttgttcatatgtatgtcatcactaatcactatacttttccttcaatagcagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacgggtatgtgtggagtccactgttctgttccctgcgttctgtggtggctaatgaaatttttttaatgttcattttttttatgttcatttttttattgtggtaagaatactatgagaactaccttcttaatagatttttaagagtataataaagtatttttatgtataggcacgaccattgtacagcagatctctgaaacttatcttgagtaactgaaacttcacgcccactgtacggcaactcgtctttccggcctcccctcaattcctggcgaccaccattttattattagcctctatgagtttgactcttagatacctcgtgtcaggtggcctttgcatctctttccattaagattctcactttttggacctggtgcaatggctgacacctgtaatcctagcattttgggaggccaggagatctcttgagcccaggagttcgagaccagcctgagcaacatgacgaaaccccatctttactaatattagccaggtgtggtctcaggtattcaggaggctgaggtgggaggatcacctgagccaggggaggttgagcttgaggtgagctgtgattgtcccactgcactcaagcctgggcaacagagcaagacctcgtctcaaaacaaaaagaaaaacaaacaaaaaaaagattctcaccctttattcctgtacttaatatacatttctggtctatggaatattttttttaagtagaaaaaaaatgaatcttgttgaattgtttctgctaacataatttacattttcatgaccttaactgtttttttttgagacggagtttcgctcttgtcatgtaggctgcagtgcaatggcctgatcttggctcactgcagcctctgcctcctgagttcaagcgattctcctgcctcagcctcctgagtagctgggattacaggtgcccactaccatgcccagctaatttttgtatttttagtagtgatggggtttcgccatgttggcaaggctggtctcaaactcctgacctcaggtgattcaccagcctcggcctcccaaagtgctgggattacaggcgtgagccaccacacctggcctgaccttaacatttttaatggcaacatattacattatttttagctcattttcagggacaaacaatttttctcatgtatatgttttctatatttatctaaaattgacatttttcctgaaatgccttcttttggagaagctttttgttcaagctattttctatatgtcattgataattcttttctttgtgacatttacaatgtgtagcttggggatttctttgtagttgtatgttctgttatagtaattcattaaaaagtggtatggttttaaattacagataataaaagaaagttaggaccttaatgttacttttgggatctgaatttcatatttgttatgacatgtcatttctcaggattctaatcactgtattgaaatatactcactacttgctaatatgtttactaaattgatgcttccaaattttttcaacattagatttattttagatgagtaatgtacataatacaattaggtagtgaattattattatattttttgcacaaaaaaattaacagtttgtgaagtcaccacttaatctttagtagcccaaagttagaaatgttgtagacaaattttgaataatatccaattctaagatgatatgcctaatgttgccaggtaagtgaataatattttatctttatgtttttttctctgatgttacttttcctcagcttcctgttctagccccagtcgtggttattaagctttagtttctagatggaatcttttctaagttagaaataattttttttcaaaacttatactctaaatttggaaataattctgaggtttaagatgtttttgaattcctgctgaaaaagtgaattttatataatttcgaaaatattctaaaaattaaactttgaaattaatttttacacattatctgaaaattcattctataggcagaaatgcaactttatgtgttatatattttctctagtttatacaaagactatagaaagaattaatttaataggtcattcagggttattttaacagatacaaatgttgattgtataatagtgtctttaaccattcattataaaacatttttctataaagagcaacaagataatctatgatacttttaatgaaagctcaattcttaattttaaattcttaatttaaaataaatgcacttaaggatgatattttcgtgtggttttaaagacatttaactttctgtggactttgttctgagcttaagtataatgtttccagaaattgattgctctctccagatttttgcaagcttacggatctcacacaccagtaaagttttttaaattatgagatgcatctatttgacagacctggaacagttattttttgccactaagatttctactacagatgcaagaaagaagtgtccttgcatttcctttctgattgtggcagccaacattgaatgggggaatacaggagaaaaacttggtaatacagggaaaaaaacatggagagataatttttacagttcataaataactttgtaaacagtgaagagcttgtgttacaatccagagaataatctaaaatttgagtttaaaaaattatgagaaccaatagatggttgtcagcttctgattcacgtttgcttaaatatgggcattgaaaaacatgactgcactatcatatcataaaataaggaacattttcaaaataaaaaactcttaattgtatataataaagggcacctccttaaactgtataaatgtatatgtatgaaaatttcactactttgcctgtttttcacatttctccatggacctgtgagagctttattatgagccagccctggtgaggaacctggttctggagcacagtataggcagaattttaaaaatatttagtcctagctgatgaagaaatggacctgaagagtatattgatcatcagtgtgactaaatactaaactggattgctaagagagttatggaatattttgtaagaccttaaggaaagaatagctaatcacctgttccaatttctttcactaaagaaaagcacttggattaggtgtttctgtgaaggaccttcccagccttgtttttcaaaagtctataactcttatcttaaaaatctattagaggatcattcattaaactattttaaaaacaatttagttcatttctgatgaatttatttaaaacataatatttgcacatgaccgtgatagattagaaaataaaactggttgtagtgatagggtgattatagtttctccttgggatcagggaaaccatggaccactgtggaaaaagtctgaggctggaacttgggacacactaagtgaggcagagtgatatttgtagttttgtaaatcgtccacagcagttaccaacacacaagaaaggccagttgtgagatggggttcacaatgaagtctgggtcctgaggcaaatgagaatttatcttaacttctcagattatgtttggataaacctaagttttctacaggttaacaaattattagttctgaaatcaaatatattctgtgaaattacagtaatattaatctgaagctaactgatcaaatctattttcctaatgtaatattatttattaacattaaattatgttgttaaatgtcacaaaggtgatatggccaaaaattctattggttgttaaatataatgtccttaaataagagcgccttcaatcatttttataaaatagaaactgctgtcatcactaatatccaagcacctgaatgggaacctaccaggatactgaacaaaacttctgtaacatgattcagactgcctaaacagcctcatttcacaggctaattaaaatcagacagcctaagaaatgtagagtaattgttggtcagctagagatagataattgctttaatttacccaatattctactgttaagctgaacatttagaactggaaatatgccatgtgattattatttaaactaagatggttttttaatattaaaataaagatctgttttgccattgcctcaatatggcttcatatctttgatacagcatattttcttaaaggagtagtatctatatgtcttatttatgaagcaaacatttttattagaaaaaattgtaaaaccacatgacaatagacagttatgttttcatttgtaacccccattgatagaatgagttgattagatactttttagaaaaatgttctttacaacagtatgtcatattatgttttcaaatctgcctgaatgttttctcttttaatcctgtcagcacctctgttagatagggattataacatcagagaatctaagtaactcacctgcttgccacagctagtaataatgaatgtttgggttctggcctgaataacaagctcttgcccttcctgctgtaataggagaaactcaatgtactaaactcaaagtacaaaactcagtgtactaaggagaagtgactaatataatcgacactgcgcttcctaatgcagcagccaggagcatgatgtctctaaaaggaccctttcatcaccactcatgtatcctgtttttgtactttttcatttctagaaaacatatgacgtagtatttactgagttactggaagtcctttggaatcacttcaaaatatcaatataaagaaaagcttttcccctcctattatagttgcatttcctagtgaagaagctttacttgtgaataaatctagcatatgccctatcagttttaattctcaagacaattctctgaaattgggttttataagatagattattaaactacttttattttattttattttattttattttattttattttattttattttatttttgagatggagtcttgctctgttgcccaggctggagtgcagtggcgtgatcttggctcactgcaacctccacctcctgggttcaagcgattctcctgcctcagcctccctagtagctgggattacaggtgtacgccaccatgcctggctaatttttgtatttttagtagagacagggtttcaccacgttggccagactcttctccaactcctgaccttaggtgatgcataaactgcttttaaaaggaagaagtttttctgtaggagacactattcacttttttatttgacgtagtgagttagcttaatgacagttggttcttttttattttttgagatggagtgtcgctctgtcacccaggctggagtgcagtggtgcaatcttggcccactgcaacctctgccacctgggttcaagcgattcttgtgcctcagcctccctatgtagctggaattacagatgcatgccatcatgctcaactaatttttgtaattttagtagagatggggtttcaccatgttggccaggccagtctcaaacctggcctcaagcagtccacccgcctcgtcctcccaaagtgctgggattacaggtgtgagccgttgcgaccggccaacagttggtactttttgagccgacgtaattatggggacatttcaggtagttccctgacttatgtgccttgtatcatacctgttacttacctaactatggttatgtataaaagataaaatcatacccatgtcataatttttataatgatgtaccttttcatttttctcttccttcatcattgaaagatttatacttcaatattaagtattcttaaatgtttttttttccccagaggcacttaaccttcactataaaaggttgaacgtgacagtttttccagatatgatggtaacagtgtctgcttccataatccttgtcttgtatttgcccctttcctttcagagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacaggtatggattagaatttctgttatatatttatagaactgggtatattttattacaaaataaattatatgtgaaatgaatgtatctaacttaagtaaaggaattaatggctgagaaaaatggaattccatgtttactattccaaagtataaagttgtgaactttttattattttaattcaatttagaataaatgtaaatgatccaaagatttagaacctcacaataggccgatgatgtcagaagttagaccatagtattattctttgtcagaaaacaggaatctttttgaaattatatcattttgaaggctcttaattctactcaggccaaaaggaaaaatcccacaagcaaaaacttattttaaaacattcttcctattcagtctgacagagctgcattcaggccgagtcagttgttatgtttttgccacctggaggcgttttcaggaatgactcctttccttctctttctacgtgttagagagaagggaccctcagagaccactaagtggataccttcttccactctgtggtatctccttcatgcagggaaatgttcctttgagcccacttctcagcctcaaaactatgtgctgctaataatataggactcagtaaagattctcccctaaatgattcagtcacatatatgtaggtaattgatatagtccacagttttcaatgctttgtgacaaacgggtatataatttcactatttctgtctaaatatgaagtgaagcattggaaagtcagaaatcatctagtgtattgacgtaatccatgtactagtatttctactttttttccttctttttgaaaaagctactgctatgaaaaagctcctgaaaaaactactgctcatctaatggtatctggctagggaaactaggaatcagcaaatgcaagatatactgtttcttcttccccaaagaagctttcagagaagatgacctgcccatgatcaagtatcagtgttcttgagaatgtatcatgaaatagcattatatagaatatgaaaagtattattcattcatcatccactaagagttgttgtgtatcccttaactatagggtcctaatgtcactttatctgtccttactgtcatttttcatcaactctaatcttccactaatagtagatacatactatttttaatctgtcatctaacatacaattcgaatatttagttaaattttcatagtacctttactcctgataaaaagagttatagcacaaataattgaacattaactttgtttgcctttttgttcatcaatcgtccctggagggcaagtggtgtggaattttttttttttttcctccaggactaatgagaagtatgtagtgggttatctgcaagctcttgccagttccccattatagccagtggctcatatttttaaaagctctctgaggttgaaagtgccatcaggcagcttggatcagggtttatattttcaggcaaaagacaatcaaatttaaaaggcaaaccttaaaaaacatttgggtaaagaaatcaggttgaaaagaaggaggaagaagggataaaggtgataaggagcagatataaaagaaggacataaatacttaatagtaagaattgtaagagtctacagcttggtcaacatggtgaaaccccatctctactatattcaaaaattagccagcatggcagcgcgtgcctgtaatatcagctattgaggaggctgaggcaggagaatcacttgaacccgggaggcagaggttgcagtgagctgagatcgcaccactgcactccagcctgggtgacagagcgagaccccatctcaaaaaaaaaaagaaaaaaaaaaaaaggtagtctaaagagtccaaacactgaatagcacttacttacatatttacagggaatctacttatttttgtaaatcgatttttatacttgccaccttactgaattatattattctttctgatgatttttcagttctcttggatttgcttagtatgcagtcactttgccgtcttaaaccagaagtccccaaaggtgacccagttgtttcccagcttaaaaccattcattttccttctaaatgtccttaagataaaacttcaaaaatccttcatctgaactaataggacactctgtgtagtcccttttcacctcttcagactcatctcctaccactctccccttagtgcttcaggggtattagttgcctttcagcttcttgcccgagccacgtttgctcttgattcagaggctttctatgtactgctgactctgcctggaagattctttgctcccttcttcatgcagctaagccctactcatcctttaggtttccctttgaaagccttccctaatccccagactagaggaaaattcccctcctttgaaccatattaacaccccttacttctgcttccctggcacttaccccagttgagatggagcggcttgaagaaaggagtgtgaaggttcgtaatagctgctatggcagtaagcaaaaggactaactggcgagaagtgacaagattactcatcatcattgtgggcccagtttcagaggggacccaggttttggtataggaattagttagcatttttggcttatggcatttacttcaacagtattccacagcccaggagccagattagttaagctaagccagtagtagagattttgtgcatcccccactccccaagtcacatgacaacgtttggagacattttttaatggtcatgactgcagaatggagttgtcctactggcatttagtgggtggaggccaaggatgctgctgaacatcctacagtgcacaggacagacccacacgaccatgaattatctggccccaaatgtcaataatgccaaggttgagaaactctgatctatcagtgacctcagggaaaaggaaaatagactgtgttgggatgtaggggtcagaatacaagcatctccttctccttcccttggaatatatgatgtgtatctcaaattctcattctgtattgctgctgctccacacactgccttgcgtgacaggtcatcaacttcacaaaccaccaaggttaattgatttattctcagaatatttattgcctgatgttacatgcaggaccacagagaccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttcctttttgctgaaatcttgtctcttctgcttcattctcatatatctgttgaaagctgggactgtgccatgcccgcaggctttgtatcttgtgtagcacccagcagagtaccttgctcacaatagtctttaataaatatttgctgaattaaatgttagactctcaaatcctgcacaacagaaagtctgataataaacaaagcgttttggcagggcacggtggctcactcctgtaatcccagcactttgggaggccaaggcgggcggatcacctgagatcgggagtttaagaacagcctggccaacatggtgaaaccctgtcactaatgaaaatacaaaaattagccaggtatgatggcacacgcctgtaatcccaactacttgggaggctgaggcacgagaattgcttgaacccagaaggtggaggttgcagtgagctgaggtcgtgtcactgcactccagcccaggtgacagtgagactctgtctcaaaaaaaataaaaaataaagagttttgaagatacggttttttggctaaattttcttaggttaaggatgtattatttcagtgtcacgtcaccatcacgcatcatacctgtattgtttcttaatatttttgccagttaagtttagacttttgaaaattctatttacttgatgataatactgaaatttgtcctccagagactcagtgtctcataatatggaacactttgatttattgatttgacagtcatttaatgaaagcctactatgggtaagatagtgtgctaagtataagaaatacaaagtactggtcgggcgcggtggctcacgcctgtaatcctagcactttgggaggccgaggcgtgcagatcaactgaggtcaggagttcaagaccagcctggctaacatggtgaaaccccatctctactaaaaatacaaaaattagctgggcgtggtggcaggtgcctgtaatcccagcttcttgggatcctgaggcaaaataattgcttgaatccgggaggcagaggttgcagtgagccgagattgtgccattgcactccagcctgggcgagaagagtaaaactccatctcaaaaaaaaagaaaaaaaagaaatacaaagtattgtatacagtgatgaacgaaataaccaggacctcattcattgaggacttattcattacagtcttataatttttaaaagggatatacaaaaatatatataaatttaaaattttaaagtattatgaaggaaaaatagaacattataaagtatctagaacctatgtacggaaaatactgcactatgggttttttttttagcattttcttgaaaatgatttatttctcaaaattctttgaatgctgatttcattttttattgttctgtcatcacccaagtaatcacgcatacttgcatttattttcctctaaggacttttaagcattaaacttagaaaatgttcatataaagaaggcttagagacataattagctcaagagactgatttatactttaaaaaaaatcttctagtagaacttctctgagtaatttttcacatttttaatgttcttcccagattaaaatacaacattttctaactgtaaggagaaatgtaatttgccaagtatttttttctctatattattttaaattgaaagtaaaatggtggattaaacttgttctaattttcaatcacaatgtttaaagaatatgtatggtaattgtgtacctattgtatacatattgtgtacacattctcattgtgcacacacatacgtatagacagagagattcaccaagccagtctgtctaggaagcctaccactaaataaatgtcttacagctgataactgttaaaaactcatttgtgtttgaagccaatgttgatgagtttttctgtggatttatgctgcaggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggtacaattgtggcctattctgtataatagtattatctagcactgcaaagaaaactagaagaaaaaaatctgttttctttttaaatcaaagggtcttctcagataaatttgctacataaaattattagagttgagtgctaacaaacttttagagttaattcagaaaaattcagaaaagcttaatgctttttttaaagacacaaattagaaaatttaaattatagaaaacttttgcatatagacaatggtgctataaaagcatccttttatagtcctattttatcacctcacattgaatgctgaattgttttttcaactgcatgtggactgactttcactttgttatatgcttttttttattatggtagtaaaaatacaacaaatatacccccttaacagatttttaagtgtgcaatacggtattgttgactataggcacaatgttatgttgttcagaaatctgtagaacttaattatcttatataatgctacattcttttgtctttcagttaagcctcatgagcagtgggagcttatatactataaacaatgaaatgggaaaacaaaggaataaggacttcaattagagagaggaaatattctctcaattaaatttagagattttccttctgtgttttaaaattattgttccaatgacatatatatatatgtgttttttttttttttgagacagagtctcactctgttgcccaggctggggtgcagtggcgcaatcttggctcactgcaacctccacctcctgggttcaagccattctcctgcctcagcctcccaagtagctgggactacaggcgtgcaccaccatgcccggctaatttttttgtatttttaggagagacggggtttcaccatgctggccaggctggtctcgaactcctgacctcaagtgatccaccagcctcggcctcccaacctgctgggattacaggcatgagccaccaagcccggccccaatgacatacctgttttttaaagtaaatggcaaataatttttgaaggtaacattccttttttgaaaattactataagtttcaaaacatgtttttttgaaggttcatagcagttttatttgtaatagccagcatatttcttttgaagtaaaaaggttaaatctggtgttttattatgaaaaagcatatatggaaaagttgagaaataccccatcagtgttttgtagttgttgttaatttacatctcctaagtaattttttgtttcttagggagtgtagagaaaatgcacacacacttttccctggtcatgtgaaaaataaagcttccaaattgaaatttagagcaactaagatacagagacaacagagcaaaatgtttttgagcctttggggattattaagaagtaaatgttgtggagtgttggcatactttgaactttctcttaaatattttagcaacttttaggaaagtttatatcaatattaaatatataacatcatgaaatagtttgtttaacctgcttattttaaaggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccaggtaacatttgctactctgtctgctctcaggataaatgtgccttttattcctgtagtttttatgtttatcttaagatgttttctccagttatttaaattgttctctccctggttagagcctaacatcactcatttgaactcaaatccgggaatatccttacaagtagaaagcaccatcagtgctcctaagactgccatgtaaccacagcagcatatctttatagagcagtggataacagttatagtacattccttaactttatcccctttaaaccctgaaaccacttgatgaacttaggagggagttatagtcttcattttagagatgagaaaagcaaggcttgaagagatcaagtgacttgcccaaggtcactcagcttataaacgaagtggtcagaatttgaatacaggtcttctggatctatgtgaaattctgtatttaggcagtataacatagcggttaagagcatggactatggagttaaactggggtcaaaagccagttttgacatttactagctgtgtggctgactttgggaaagttacttaacctctctaagcctcagtttccttgtctttgaaatttatttaataatactgacttcagaaagtgattgtgaggattcagtgagatcaggcatataaaataattagcattgagcccagcacctctagaaacacctcagtaaatgttgttatgattaatattaatacctttgcgtcactacctattagatacagatttcatgttttaatttgtaatcccagctctttcactattctatacctattctaagtaattttctttagagatatttgtgtatcttaggagtgtctgtatgttactgcaggacatctagagagggaatattctctcttaattaaatttagggattctcctgtgttttaaaattattgttccaatgacacatatattttttaaagtaaatggcaaataatttttttttttgagacggattctcgctttgtcgcccaagctggagtgcagtggcgcaatctgggctcactgcaagctctgcctcctgggttcaagccattctcctgcctcagtctcctgagtagctgggactacaggtgcccgccaccatgcccggctaattttttgtattttttttgtagacatgcggtttcaccgtgttagccaggatggtctcgatctcctgaccttgtgatctgcccacctcggcctcccaaagtgctgggattacaggcatgagccaccacgcccggccaatggcaaataatttttgaaggagacatttcttttctgaaaattactgtaagtttcaaaacatatttctttttttgaaggttcatagcagttttatttgtaatagccaacatatttctctatttgataggggtaggacaagaaaccaggaccaggagatcagaaagtaagcagtaaatttgaaattaagaagataaacctgtcatcagggactaagaatcagggactaggaacagataatttgtgtatctttgagatcaggaagctaggcaaagggttgaggtaataaaggattgggaactcaggtaagaattgtgggccatgggaatgggatattatatataactaggaccttgataatgagctgatttcttgcacctgacccacaacttttgtatgttttcttttgaaataagatcaatgtctaatggtactcttcagccctggacatggaaaaagtagtagattctggcaagcagtatgtagtgtgtacaaggaaaaaatacatttatggtttagggaaaattgtttctcagtcccagagatttgaatgtgaaaatatgcatgattttgtagctagatcaaaaggaaatgccatctcttgtctttttgtgactgctaacactctcttaagaaaacattttggaagttgtatctaacatatactttaactttttctaaatcattcacagacttcaatctttataatggaggaaagtggatcaggatatatcttactaaggagttgtcatttaagctaaaggataagaaagagatggctacacagggagactagatgtatttcaggcaaagaaaataatatagacaaaggtttggaggcagttaagaagaaaaggacaaccagtggggctagaaagtgagggaaagggtaagataaagcagtattggagaaagagatggtgaaaaattatttacggttttataggccgtgagagacctacgtgatatgaatgtttttcttaagtgagatagaaagtcattaaaagattttaagcagtagactgatgtgttccaatcctatttctactttgagatgattatgatcacttctacctccatatagattatacagaggccagactagaaataggaagaatacttgtgagccctttgcaggagatgatagtgtatggaccaaggtgtttgcagtggagatggagaaaagaaaaagaaaagagggaagatgtgaaatacattatagacataaaaaccaaccggacttgctaaacttattaatgcaccacacatacgtgtgaattaaagtgaggaatcaaggatgattcctaagcaagaggaagcttgacacatttgaggaagaaatttaagaactaagcctcaaactaagaacacgtttgaggaagaaatttgagatctgtgaggcatccaagtagaaatatcaagctgattgttgaaacacaagcctaaagtttagaagagagccctggactagaaatataaatttggaagccatcaacatagagatggtatttaaaagagatgggcatggtaacttatgcctataatcccagtattttgagaggctgaggtaggaggattgcttgaagctaggagtttgagaccagcctgggcaacacagcaagaccccctctctctatttaaaataataataaaatccatggatgttggtgaaatcacctgctagagggtagagtcagaagagaagagggcccagaatgtatccctaagaacatctaacatttgaggggtagagaaggaagagccagcaaagaagccttcctcagctttttcagccagtaaggcaggaggtgggaaattagggcagcgtagtgtcgtgaatgcaaagtaccgctcaaagatcaagggaaaatagctcaaagaagtatccaatggatttggtataatggagtttactggtgacctcgacaagagcagttctaggggaagatcagggaagaagccagagtgttaagagttgagttatgaatggggaatgagggattgaagaggagataagatgagcagataattcctttgtctatttgctgataaagtggagcagagaaatggtctggcagctagagggggatgtgggctcaatagaaaatattggagcacatttatatggtaatgaatgagccagtagtcctggagagagagcacagaagagagaaagtataaggaaagttgcaaagctcttgcaaaacaggaggggccggcatagagagtggtctttggtaacaggaaaaacacatcctacattttaacaggcaaatgagaacttgggtacaaatataggtagttgtgtatgtttgttggtgagaagatcaagtggatcggatatgatcacttctgttttctcagtcaaatctgaggcaaggccatcagcttaaataatctgctatgtattttccaaacctatattctctgccttctccagtctatcctgcataacactttccacattgatcttcctcaggtgcaattcagtttccatgtgctccagtgtcttcagtgaattcctaatatttatgaaaataattgttaattttcccatataattccaaattctagctttatctctcagtagtcttttccttacaatcttcatttggtaataggtagtattatggtagtaatgtattatggtagtctacaaataatggctcgtgggccaaatctagctggccacctgtttttataaataaagttttattggaacccagccatacccattcctttatgtattgtctgtggctgctttctgctacaatgtcataggttagttaggacagagaccatatggcccaggaagcctaagatgtttactatatggccgtttagagaaaaagtttgctgactcttaattttgatcagactgatctcttcagtctaacttagtggaaagaacaagagctgtggagtcagacagacctaagattgacactggataccaacggtcactgaaacttaatttctatatttacaaaatgaggatataatacttaaccttccttgttgtcgtagggtcaatataacatatataaaagcatatgtttctgggatttggtaagccttcaagacaagcttctttcctctactcatttgctgagactactgttctgctgctttattaggaatgggcttcattgtcttccccttacacctccatctctgcccctcagaattctaattctactcatctttctatgtacctctgtagtgaaacttttcctgattgccaacatacggatgtaatttctcatagactataacttcattaagaaatagcaattacaattttttaacagcaaacaacaaaattgcaattgctaatacttaatgaacttattagtatatgtatacccaaacatgttttataccttaaatatagacgataaaaaataaaaaagaattagcaattacttatgttgctattctgcagattaccacacatggaataaataccaaatagttatttgctcattcaattcagtggatttaaaggggagggatcagtgtggactgtcattttttagtgaagacttcattaaggagctacgtccaaatgtattggtgatcaatgagggcatagtgagaaactgagaaaaatgtaaagtcaagtagagcctatgacttttaattatctactttatgatgtaataaccttgcagttttctgtgaaaggttctaggtgcttatactagttatctgttgctacatttaaaaaatgaccctaaaacttagtaggttaaaacaaaaagcatttattatttcacacagtttctgagagtcaggagtccagcagcagcttagctgggtggttctggcccaggttctttcatagggttgcagtcacactgtcagatggggctgcagttatctgaaggcttgactgaggctggaagatccacttccaagctcattcacatggccattggcaggaggcctcacttccttgagatgctcacaacatggactcctacagagcaagtgattagagagaaagagagggagtgcacgagtgtagctgggggtggagggggagagagagagagcaagagagccagagcgagcacaagtgcgcatacgtgtataaccaaaacagaagccataatgctatcacaattacatctgctttattttactggctgtgcacatacggaccaacctggtataatgggcaagggaactacacaagagtatgaacaccaggacgttgtaggtcattggggcccttcttaggactagctattacagtgcttgatacctgggtagttatttatcccaagggaatagtgtttgcctgttcatatgaatgaaacaattgtaatctaattggtgtcaatgtttttaaactttcacaaagattttaaaacctatgtcattgtgaatgaattcttttcaatttccctgacatgaggttaaaggacttttagtaaaattatacctacactttatattatagaataatttctgttttctgtccagttgcctttcacttttctgttgaaatctggatttcctttttcccatttaatcattcagattatttgctagatgaaatgaccaaagaagcagagatagataattcttcaactgtagaaagccttggagaaactactgatatcttaaacatggtaatgatttcctatctatttatctaaatatgagtttgaattttagttcattgtgtatgtgaatgtgtgtatacttcctatactcttatatgcatgaaagcgtctttctcgtttcttactttattttttaaccaactatattgaggtataattcacatacaataaaatttgttttgatcctcacattattagtatggcaattgagagcggattctattactatctgaactgttttcccttcattttatatatatatatatataaaaaaatatatataattgaaaatatactatatatttgtactatatacaaatatatagtatatatactgtattctttttataatatatattttttatttatttcagacacacatcatgagcctgaattccaatgaaaagtcattaaaattatcaccagttcagaaacaaaaggtataatatgaagatttattttcgttattgttggtgagagcagtttaagttaattttttggatggtttttggaaagaacacaagaaacgtaagcatttacttactttagaatttaaaagacagagggatacaatgtagataacctccattttgccttgttctgatggtatgtattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaattccttttaagctgacatatattttatactttctatagtctttttaagtttaggccctaccaggcctactttagtaaatgagaaaagatttattatactatttctgtgtattaacttgttaatttttaacttgtcatgttttaataatttctttggcacaataggaacctcttcctaggcctaactcatcacaatttataaaatttgaattagtgaggttttactatccagagacccaaattcattagatatttgcatccattagcttgtttgtagaatttagatcaacaatttggttttgccttattttgtccagcaggaaattaattttgtattgttaatgtattattcaaatgtcagtgtttgatttcatagtttttgtacaaatcttacattttacacttaatattctttccttagtgttctttcatttatagaaattattgtaattaaataatataatcaatgcaaggaagaaggtcaaaaatttgaaaactcatgaagattttgtttagaaaagaaaaatatattcattattatttagtttatagataaaaaacatctcatgtgcagtttcttcagttctaggagtggactattcatttttttcaaattttacatttttatttattttgtgaattttgtggactcaaaagacaaatgaaaatttgaaaattaggccaggcatggtggctcatgcctgtaatcccagcactttgggcggccaagatgggcagatcacttgaggtcagaagttcgagactagcctggccatcatggtgaaacctcatctctactaaaaataaaaaagttagctggatgtggtggcatgcacccatagtcccagctactcaggaagctgaggtgggagaatcgctggaacccaggaggcagaggctgcagtgagctgagatcatgccactgagctccagcctaggtgacagaatgaaactccgtctcaagaaaaaaaaattgaaaattaaagatgatcgggaaagtgggaaaaatatactaagctgtactatgtataagaaaagtgtacatttttttctttgaaatggaatttcgctcttgttgcccaggctggagtgcagtggcacaatcttggctcactgcaacctctgcctcccgggttcaagcaattctcctgcctcagcctcccgagtagctgggattacaggcatgtgccaccactcctggctaatttttgtacttttagtagagacgggttttcaccaggttggccaggctagtcttgaactcctgaccttaggtaatccacccgcctcggcctcttaaagtactgggattacaggtgtgagccactgtgccaggccaagaagtgtacatttttaaatagcatcttgcaaaattaatctcgaagttttatgtaaggattgattcggattgagaaaagaggcagagagtaaatattgatggtattgtgattaatggcaaaattatggcaggtagtaagaatcgaaaattaaacacagatacatgttactaaatcaaaattagatgtatcacagactagagagtggcacaaatgatccttaaagaaaacaaaactttagcaaaatatctggtaaaacttgctattttgattctcctaaacttataaaaatgtaaaatcttggcagtatttaaagtagataagttgtccttgtcaactaatagtagtatgacatatgataattacttcaaaaaatttacagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgtatatagtcagaaattctttatgaaaagataaactgtctagtattagatactgaattttagagaggctagatttccactagagtaatttcaattgtcccttaaaattttccgtgtacataatgcagctaatttatctgatagtttatttgtggctcctttttcaactaatttcctttcatagtcccttttatatcctgggcatgagagatttcttatacttagttttattaaggaggattttgatgagaaacttcctgtgagttttgtgtagttgagttcttttgcacagttgattctctgagtgagaaagaatatgaggaaaaagtctagaatcgtatgaagtaaaggatttcctaggagcaattgtaagttttgccttagctgcaaggatctctggcagcttcccctaactaaccaaatgtactgatttggcattgcattgctttaccgaattcgaccacattcattaagggatagtagaaaagaattaatactatgataaaaatatatgtgccgaacatgattatttaaaaagtagatttaaaataattaagatggatgacacagaattcataaagaaaaaaacctccagggaaatgagaaactcttaaactcaagttattaatgtaatagctatgagcattcatcttctactgaagagataatcagccagtaatacagaaacaacgttctaaaatacacccatctcagtattaaacctggtctatatgtccacgtttaaatagcatttcttcacatttccctggccaaaaacattttgtgctctttagaagtggtagttcatgcaagcattgttttctagtggagaacactggcctccctagtcactttgagaccaaagcccttcttctggttttgtacttttgagctgtctgaacttgggctagtctcttagctttgcagtcctcaatttcttcatctggaaaattatagaatgagaatgagtgacctaagggattctataggaacagcagttgttcattaccagctagagctctgtcacacccagattttctgcaattcctttttcctcaataaaaaatcttaagtctcgtcaccaaagcgaccccacattcaaactaactagtagttatactaaagtaaacagttatcctaaactactaagcacacactaactttctgtgcccactgttgggcgaacatttatttaatcacatgtggcaggtctagtaccctcaaaaagtttatggagaggagtgtattgtgggttaggggtgggttggggtacaaaagacccaggtctatccaggctttcatcgacagaagtgatttacatgtttgtaaattttatatatcttaggagaaaaaaaaggaagcttaagaatgagaccactttgtccctcatgaattaacacttggttatatagattaaaataactggttccttctttattgttcccatctgctggttgttcaggcttttatagtagtttattactgatcattattgagggaagtgtgagtagtatatatagaatccattgagttacatttcctaatgaggactctggctgaaaaagactttaaggtaagctgcaaaggattacctaccacagaaactgctgctgctgctgctgctgctgctgctgaacagcagcagtcaaggtgagtgcaactgaaatgtcttctattatttcactatagagaaacttgctatacacttacatagcaaaaataaaatgtgaccatggaagaaggaaaggccaagcttttcttgtttctgacctggagaactgagtagaaagagtactattcagcaagatcgagaataagggagcagaagcatgtttgggagacagttttttactgttgattttagattgtaggagatgttcaggaggcagatacctgtatggatctggagctcacggagactgctgagtatcgccagctcatagatgtagttaaaactggatttgactgaaaggaagtgttcctaatgtgaatggaggagagttgaagacagaattcagagaaatgtcagtaggtaagggagaggttgagaaagtgaagtctgagaaggaggtgtgggagcatacttactaggaaagagagataccacccaagccaaagaaggggtttcagagaggaaggagtggtagtagctgcagagagagcctctaggaggcagcctagtagagggccaggggcagaacccacattgccaggaaagaatgagctccgggaaatctgctctgcagaggaatagaatcagaactgtgaaaattaaatatcagatatagatatttaatttttaaaatatttaattttttaagcatatttctcaatttaggaagggagatgtgtactccagagactttggttttctggggaaaagatgataaattttgttcataattaatatatacataagaatagagtgttattgatgtgagcttatgaaccaaaagaaaaatctgcaatgctttaaacattagtgaggcggagaaaaaaaacatctgtgagaacagccattattatcctcaaattaaatgagcaggtttggaaacaaacatgggctccaaagtccagtagaactgagttaaaatcccagccctccactgatgagctgtgtggacacctagaaaagttgtggtggtggtggtggtggtggttgttatttgacctttctgagtcttatttccctcatttgataaaggaagggacttttgacgattaaattacctaacacatgaaacatgttataggcactcagcaaatggtaacctgtatcactctaattatactctgtgatcacaccaaggtaggtgcaaagctacactcatgaatctccaggtcactgactgatgtgcgtgagtttagtcatgtgaacctgacttttgtttaaatgtaacataatagcaaaatataaattggcttatagaaatagatctgtgggaataaagtagattgcaataatgatcatgcttaagtataaggtggagtgaaactattacacaccatacattagtcaataaatgcccctaaatatttaaagtgtgttgaaacgctgatcacactcatgtggttagccgaaaatttaggtgtgttttctgtcactgaacatttccctctgtgtcctaaccttgttatcaaaataaataaaaataattagcacataaggtatagtcgtggatcatgcatttgtttatggacaacaagaaaatcttctaaggaaaaagagtagagatagtaaagaataaatctgaaaatgagaataaaaatgctcgccagcaagatattctatactctgaacatttatttctgtaggcctgcctatcaaactggaatgtattcagtggtgagaatacaggattaggaatgacataagggagtggtgcctagaaagaaggaagagtttaagagattataaagtagtatgatcagccaagaatttggagatcacaactggcagcccatgggtgcagtctggcctgcagacttattttgtttggtgcagtttttttttatttaaatcatattggttgccaacattgaaatgtcaggagattttacatttaaaaagtttctcagccaggcatggtgactcacacctgtaatcgcagaactttgggaggctgaggctggaggattgcttgaggccaggagttcaagaccagcctgggcaagatgataaaaacctgtctctacaaaaaaattaaaagattagttaggcatggtggtgtgcgccctgtagtcccagctactcaggaggctgaagtgggaagatcgcttgagccctgaaggtcaaggctgtagtaagctgtgattgtgccactgcactccagcttgagtgacagagtgaggccctgtctcaaataataataatgtttcttggacttttggaaagcctgggtctgggagcatcacactgtggcaacactgacctgaagctgagctgaggctggcacccctctccccagttcccatggctccttccctcactggccttgatgctaggctcctggctcacaataaaaggatgtatagaggacacaaaaataagtggacgttttaaatgaactattttccagtgataagatctgggacattatgggaaaaaaaagtccaaacttactgtttttcgacagtcctcaatgcacactaagaattctatcttactttttatggaggggcctctacaaaattatttatacttatatacaaatatatagtatatgctcatgttatttttctctgtaaataatctttttaatctttacacaaaccctctgaggtaggtattgctaatgttatttttccattttacaggtagactataaaatacattcactgggtgccatgctcaggccatgagtgattagattaaggcttggaaagcagtgcttagggctttgtatttaatgcccttcccaccccatactgctgtttccatgattttcagtgtagttaaaacatgaacttacaggttaacttttcctgtccaaaaaaaaaatatatacttgaaattttgatttttctacctgatataacttaaatacaaagttttatgctatattaacctatctgggaaacattttctaccctacatgacattgaagcatgtcagaaattctgaattatagcacaaaattttatactttatagctctggtttgttttattacttttaaaaaactataatacccacggacaaaagtgcctatctcatacatgtgtccctcaatatatttttcacaaagtgaatacacccatcacaaactgatcagcatccaaatcaaggaaaaacacagtaccagctccctcagaagcttcactttaacccctttcagtcatttcccactctcagccccaccccccagcccccatcccagcattctccttaaagcatgcgatgtaattgtgttcttaagtaaacagaaacctcagtaggaacctttgctctcttgttctgttccttaagaaatatgaaaagtgttgccttgggccagaccagagtctgcacctgactgtgccatgcctgaccaatgaaacaaagggtccttttgtgagaggtcaggcccattcacttctttactgtgatcctaacgcaagacacagacatatactgaccatttcagactacctgtttacatcttcttagatggttctagtgccaagaatgtacttaaactttactctttctttttataaaatgacagtattctgccagtcactcccaaattgtttcagtttaaaaggtaagtgctttctgtgacttcaagtagtcgtccagatgtgtttagaataattttaaatgtgcttagtctgtgagtgctatgatgtgatttctagtgaaaatgtcattttctaatagctttctcaaatttagaaaatgatatagttccaaaagttcttcattgttatagattgtttaaagttaatgagtaaaattgtagtttgttatgagtgttttacttatttctaaaataaggtaaaactcccacgtgtctttttataatagcatgacattatcctgtggttacatgaatacctcagttaacaagcccagttggagttgacccaggtgctaggttagccaagcttcccaagtaattgaggattatgctgggaacacagctcactgatccctccctctgtgaaaagaggggcatagtctgaaattccttgtctcaggagcactgttctttttagttaacctttcatttatgtatatttatgcagacaactatcagtcataagtcttaaatctagtaatcttcccattccctttcaaagtgaagttgtttctgataattttagctacccataatgtatacctggctaggcatgatacacaatataagtcactcaaaaggggaaatcaggctgggcgtggtggctcacgcttgtaatcctagcactttgggaggccaaggcgggaggatcacctgaagtcaggagtttgaggccagcctggccaacatggcgaaaccccgtctttactaaaagtacaaaaatcagctgggtgtggtggtgggtgcctgtaatcccagctactcgggaggctgaggcaggagaatcgcttcaacccgggaggtggaggttgcagtgagccaagattgtgccactgcactccagcctgggtgacagagtgagaccctgtctcaaacaaaagcaaaaaacaggcggttggaatcatgcagacaaaaacaaagcttaaaagtaaatgataactacctcatgttaaccctacccagtctaatcaatcatcatttgaaatagctgtctgccctggtaccatgttcctttctcccacattcctctcttgcatacattgcctcatgaccttggattaacctaaatctaattcttcctgagtagcttctgaaactctttttaaaatctcaaagctttatttacttagggcttcctgtcctcagtgggaatgctattaggccacgcctttgcaattggcctgaggatgacactaatgtttactattaaggtgtactgtataaacatcctcttcctagcctggactctcgcattttatatttttaccagaagaaaggtgagttaaattttagaggcattattttccaaccacctactaaagattctgttgagtatcagtcaggctttatccttagccagacagctactagaaagctgaccatcaaaagctaattacagtgttgaaggggatatggtctgaagcaaatattgccaaggtgaactttgtacaaatgttatttgaaggagtaaatggcactgataactgcttcacatattttagaagcagttataataaacttaattataataaactataaagttataactttagtgaagtgtgtaaatgaaaagtatgggggggaatctaatgagaaacctaatatcttaatgacaatcagagtatttcacccaaaattagaaagttaaaaaaaaaaaagaaatctcagtgtagaataaaggctgaaactaatattttctgcctatacttaataagcattccatgatttactatcagtctatcaaatccatagacagcctcttttatcgtttggattagctggccagtagccagacagaacaagttctgcctctgtttggttttccttctgcttttaataaccatgagcaaaccatttaaactgtctatgttcctttatcttttttcctggaatgtaaataattatacttatcttcctcatgactgtcagtgaatcgtacttctgaagtgattctaaatccctatattttggaaaatgaatataatatatagatatgattatgttataatgctacagtagacagaacgctttttaaacttttctcaaggttgaaagcattgtgagacaaccaagaaagagtatttattttttttttccattgtaaccttgccatgggtgctagtaagaattttggaaatcctagtcattgaaatagagtggcatgcgtaaaatccttgttaatacagtaacttgatattcagcatggactgtacagtatttttttcttcggcttcaatatttgaattaatattttcctggtttttttagatgacacaaattatttatgacagcaatatcaaatccctcgttttttaacaagaaaatcttactcttctctgatggtcaattttgtcacaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaaggtatgatgatagatgcttaaatcctgagatcctgggagaaaacatatgggttctctagtttctgcagaggacagattccagttgcctttgggatcagaaatactcccatgaatacatgaatacatgaattcatgtgccataagagaaaggctttggcttatttgtgaactaagcaaactttgtctctagcacactttctagaatgctgcttggtagcattctgcctcccgcatgagtggaagtagaatggtatgggccaggatagtacaccgttgggaaattaaccaagaagttcagcactcagtccttgaaatgctgaaagtgcaaagttaggagccctggcactggtggcagaaatggggtgtgtatgtgtacacacacctgtgtatgtttacatgtgtgaatgattgaaagttggtcacagcagtatttgaagttgtgatcagttcttcaaaggtgcagtctagacaaaattatgtatagaaggaataggagaagatatcactaaggaagcaaaaatcaccctgaaagtggagctagagaagcccaaaacataatctcttccattggcagttttgactgagagtgaccttgctaggagatagtttgtaggtttgaaatcatttgtttgctaacactactctggattaacttcagaagtatggaattccgcaacccaaagtgaatgacgttgtactgattcatctttattttcattttttgaacctctcatgcagaacactgagtcataccttctagtatgaaacactctcatcattggtctgttgcaaggctcttctcatgtaaatgtattctcttttagctccattccccttcccctttttccctaacatagacaaccactgaaacatatttgtcattttatttgaatgtgtacttgtgaaacatgttttgtgtgcatacatttttaatttacaaattggtattgtggtaaaggtcattcttttgcttggttccttctttatccaagactcctttctctcactaagaaaaaaaatattctagcagttactgttttatttcagaaggagaaaatgattctgtttatagggaacatttatgaattcaggttagggtggtccttaagattatttaacatagaaatcattaaataccaatttgacattgtaaaatgttgagacaagttgtatgccaattagcgttcatgaatcttctttgaggagaattcttgagtcatacagtttttttaatcacacaattttaagctaggaggacatttgcaatcagtcagcatctaaggcccctcactttacaagagctcagcaaagtgaagtaattgtcacatgtttatgtcattagctagaggcagactctagaacctgcttaaagattcagacttaagttttctagaacagcacaaaaatattttttgttatattgctttgttattgtttatagaaagaaaaagccaacctagaggaacgggccatttgtgagtacaatgaaaacccaaaaggtatgagcacatttgataacatacatatatacatacatacatacacacatatatatgtgtatgtatgccataattgggtaattataagcttacatataagtttacatatatgctataatttttactgtcacatgatcctcataacaagctatgaaatatgtgatacagacttatctgttcttatatataaccaccacagcttcttcacatacaaatattgcattattcatggctacttatgtgtcaatgttaaggaattttttatttttttttgagacagagtttcgctcttgttgcccaggatggagtgcaatggcacgatctcagctcattgcaatctccacctcccaggttcaagtgattctcctgcctcagcctcccgagtagctgggattacaggcgtgtgccactacacctggctaatttttatatttttagtagagatgtggttttgccatattgtccaggcgagtctcaaactcctgacctcaggtgatcctcccgcctcggcctcccaaagtgctgggattacaggcatgagccaccacacccggctggtgttaaggaatttaagtagcctttttactaccttttttctctctattaaatcagtattattaaatcaagcttttgccccaaattccaatttatatctctagtgcacactgctagactccattgcccaaccaagttgggactactgggctggcctaaagccacaatggccacccagttatttacccccgagggctcagacctgagtgtcttaccgtagatactgaagagaagtcctttcccaagcctacctatcagtgtcagagagcaggtgctgtggaatagaggagactgtgattgcccttgagatctacataatctagacacaaatcatctgtgtttctgtagtatgactcccacattgtttccacaccatcacacggcagtatgattgtgttctcataaaaaaataactatctgtaatactggatatctgatctaaacttaagctgaagaatgaatagtttccttaatcctgttccttttaacttctgccataagagtagtaagttttagaatattttaggcaagtgttaaaaaatgtatcacctataagtattcttaacatatagcctaaagcactacaaagaaattaaatataagcttaaaagtagttgataatataaaattaaaacaatgcatatgcttcacaagtatactttgaagataattattcagatatagaacatgtggattaatttgaaacaccaaaaaatagcatgtccatttgagtacaaagaatgtaattataactaggttaatttttaaagtaatttgtattttacagaagtcttctctaacattgactattacctttgtagctatatttggatactggtcatctaaacatttacaactttggtgaggtcattctgggcttttcactttaactcaacttttcaggaaatatgcagtgtagatgttgtccactactccaggggtgagctcttttcgtattaccccacaactcagggttcatagagtttcactgagagcatcaggtcttgtctttttcctattagttaaaactagtatttctgaatgatccaattgtaggatacatgcttgatgatgcagatagcagttcattagaaatcctagaaaacagtgaaacaacaccaagcaaagacatgaaaaaaacaaagaaggtaagtgaaatgaattgtcttttttgatccttttgaattcaattgtttgttttacttttcatatggcaatccacataatttaactctcttaatatgagttttcatggccccaaaacctgaagaatttcaggtgatgtcgcatatttttaatatactacctttcctttggttagcatttgaatgatgatcttcttttcatccttttactttagcttatgttttagatgtgtctcttgtaaatggcctatacagctggattttgtctttgacatttttaacatgcatacctaaaatctaaagctcatcaatgttcctatctttttcccaaataatgccaggaccttagaagaattttcttgcctatcacctcttctttcttattttagaagttatggtacccagtatttaaaattttttaacatcacaaatcgtatgtttttagtattttttatactacttttttactcagatgtcccctctggaattcttattcttcctgaagaaatattttggaagttcctatcacagatgtctgttgacagttaaaacttttagtttctgttcacttgaaaatgtctttattttaccatagttcttgaatgatagtgtggctcgttgacagttattttctcttagtatctgctcccattattgctgtctataattttgctttagtataattgctgataactttgtatataacctgccatttctctatggctgctttttagattgtctttggtgtgtttcagttcactatgagatgcttaagtatggatttttttttttttttgagatggagtttcgctcttgttgcccaggctggagtgcaatggcgcgatcttggctcaccacaatcctgcctcccaggttcaagcgattctcctgcctcagcctcccaagtagctgagattacaggcatgtgccaccatgcctggctgattttgtacttttagtagagacggggtttctccatgttggtcaggctggtctcaaactcctgacctcaggtgatccgcctgtcttggcctcccaaagtgctgggattacaggcgtgagccaccatgcccagcaggtatggaatttttaattttaacttacttggaatttattatgactcttgaatctgagaattcatgtcatttgtcaatttttttaaaattctcatccattatatatttgaatattttctctcccctctttcaaattctgatataaaactttttattttatgggtacatgtcttttaatatcaccttcttgttttctatgtgtaagtgatattctgggtaatttcagggccttcatcaatttcatagtttctcttcagctgagactacttggctatttaacctacctatttaaagttttaatttcagtgataacatctttcacattttaagtgaagttgtatttttgttctttttcaaatcaatctggtcttttaaaatcagtatcttgttttatgcttactttttttattctagtcttttaatttaagcacacttagtttacattctgtatttagtaattccagtgtcatccttagcagtctaaatgtgtgttgctttggctgacttgctaatggtgattagtttccatatgtgttttgaaatttgtattgtgagttcatgtttcactggtactttttttgtggaaatcctttaaggcctctgttagagtaagtctatctatagagagtttgcattagcctttattagctctggagtgactgaaggaccactttaagttcatttctcatttaagggtagaccacaatgtttgtaggtagacttatattaagggcatagtacttagaaggtcctcacattatgtaggggtctcagttccagttcccctcattttgtgagatcaaattgtttcaaagttaaaagtctaagttatgagtcagcagatgctatttcagttcttaatgacctctgaggcttcctgttccttctttcttttttggtctacaaggatttcccttagtttttggggagattacctgcacattataaaattatattttttatacttaatcagcatttcttggtattttatagtggcagtctttttgaagttgtgtatttcttcaccatagcaggaacaggagttcttccattttaatccatagatcctttttctagattcttactttttggattatcactttttaccctagtttctccactctttaaagctagaagtaagctattattattagcaccatttttatttctggaagagccaaattttcacctggtttttgtttcctgctttttgttttggcatcttgtcaaaaccattatttgtgttaccactcttcaataatcctattttcttcctggctacattctcaaagggcctaaatcaaatgaaacttttatcaccttcatctcttctgcatacatgccctgttggccactcccttcttgatgtatttttctctcctgacttctgagctgcctagttttcccaattttgcacctacaaaccttggtcctcagttctagctcctcttctgcctgcctctcactctgctctttttgcctcttttcttatattctgttttctacctgcctggaatctctgggttatcggggctactttcatctctcagctattatctatattctacatatctgcagccccagcctcccctgagcagcagctctgtatatttgactgcctactcagacccacacacagggctcacacagccatcatttggcagcactgacttttttttttttttttttggggacagagtctcgctctgtcgcccaagctggagtgcagtggcgcgatcttggctcactgcaagctccgcctcccgggttcacgccattctcctgcctcagcctcccaagtagctgggactacaggtgcctgccaccacgcccggctaatttttttttttttttgtatttgtagtagagacagggtttcactgtgttagccagaacagtctcgatctcctgaccttgtgatctgcccgcctcggcctcccaaagtgctgggattacaggcatgggctaccgcgcctggccaagcagcattaacttttttgccagaagttctcatctacaggaatggggaggtacatcgtccttcttcagaatattacaatagaaattcactgtagctgcgatacactgagaatcacagacatgtcctgaaaatgacccctcctggatacatttaaaagttacaataggtaactttaaataggtttttatatattttttctcttacaacttaacaaagtgaaacattaaatttgttctttgaagaaaaagatatcaccaaggtgttgatggtgttgaatgttagaccctgagaggtcttgttttagggtggaatcctgactgccttttggtgaaaggaaaaactctaacagatgctaagaatgcaccatagtacatgtggtgccccataaagagatgacaaaatcatgttcttacgtgttgaaaatgatatcccctaaatactgttaagtgaatgtttcacttatggaaatgaatatttgtgtgtgtggtttttttcctagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtg

SEQ ID NO: 5641 - DNA, 57986 bp, human
gttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccggtgagttgcgcccgcgccggtggcggaaggccgggagggagggtccgcgggcggccgggccccgcctccggatcggccctgtagggggacaggccccaggcttggcagccggactggggcgggatcgctggttgcgctcccgcgaatgactgagggcagaggaccggacgggaagaacaggatgggggagaacgggaaagagggtgcctgtctttcgtatgctttttaaataagctcttgatgagcttcttgaaggcagggacactttttttttttttttatgagacggagtttcactcttgttgcccaggctggagtgcaatggcgcaatctcggctcaccgcaacctccgcatcccgggttcaggcgattctcctgccttagcctccgagtagctgcgattacaggcatgcgccaccacgcccggctaattttatatttttagtagagacggggttcctccatgttggtcaggctgatctcgaactcccgacctcaggtgatcagcccacctcggcctcccaaattgctgggattacagtcgtgagccaccgcgcccggccagggagggacactttctgtaaactccccaaagtgcggactccagacttgtgcactttggaggtcctgagctcccggttatgtattgaatgcagtaaagagtgagtgatcagggctgtggggtaaaaggggatacaggaaataaattggacaaagagggagaagagggaccctttagcgagtgttttttagccttttttttcctgagctccatagttagaaatacttttgacattgtgacccgatactccatatataccgtgtaacagaaatagatgtctggtgaagcagtccttgttctatccacttagattccacacacacctttttgataatgcattcttttaaaatgctgatcgtgatccactgaattgattttctggcccactaataggtcacgaccattttgaaaaaacactgggtttgagcagaatcataccttcactgaaatatgtatgttttcttccatgctcctggccggaactgacattcctggcctgcagttcacaatttagtgagacatacaggaaagtaaacaaaatgaccatataaattgacagtagatattacagggccagagcagagccaccaaaccttggcttgggatgagggtatcagggaagccaggggagccaagacaaaacagttaaaatgttaaagtaattcattctggggaaactcagagtctgttctagatcctagtctcccaactcaattattagttggaactgagatgcctcacagtggttctcaaaaagttgtccacagtggctagtctcttgcgtattaatatttattattaatacttatattcgctatgttttcctttctggtacgaattagtttatgtgtgatcacccaccttgggatttccccaaaagctggacctggcctactatttggtgtatgtgtgtgtttaaatggttattgggaaatggtaggggtttttagtctttcttcaaaatgacgctgtgccacaacagtttgtgaatactactcagatcaggtaatgacttgatgtaagaatgttaaaatctcaacatccccatgtactcctctcccaatctcctaggaccgtggcattttgtgatgatgttttggggggaaagataaaccgtcctttcccatgtactgtttctggaaagagaaaaagacatctctataactaactatagtgcatgagtaagatgagaattagaaacttcctgagtagctgtgttgagaggatcttttcattttataactggatccctaaacattctgaattctcagaaatcaggaaaagctaaagtgctcctttgttgacgacttggtaacctgtcttttatattaacaatgttgaaagttatatttgactacaaactctccattatgatgaattggtaaacaaaacattcaacagttacgaatatacatgtgtgtaagggggaccttttctgtgtgaaaagtagaacacacaagggctactttgtgctaggcaatatgggtagtgcataccctctgtaaccttagaaaatagttggaaaaaaacaacatttggggtaacaaatggtgaactctgtgtttcaacacagaaaagcagtgactttttttttttttttttttgagacggagtcacagtcacactgtcgcccaggcttgagtgcaatgatgctatcttggctcactgcaacctccgcctctggggttcatgcaattgtcctgcctcagccccccgagtagctgggattacaggcgcccaccaccacgcccggctaatttttgcatttttagtcgacacggggtttcaccacgttggccaggctggtctcgaactcctgacctcaaatgatccacctgcctcggcctcccaaagtgctgtgattacaggcgtgagccaccactcccggccgacatttttaaagtatagctttttattgctttgtgatgacctcatcttacatattgtgctacctaccaatctctctaatcaaactgttacacaaatcttgctgatttgtgtaacagtttgattagagagattgctaggtagcacaattatttgccatataaattctacagatcacgtagttcagagaagccagtgatcatttccaactcttatggtagaggaagagtttacagaggtagctattgagctaacactttgaggatgctaggctctgggctaagttctttatacatgtcatctcatttaatccttacaacaacctttgaatacctaattgcctttaaagcctatggttttttttctagctgctttcccttagttcgaatgaaagagatagtggtggagtaatttgtttctctctgtgctgtctccggttttatgggtattcattgggattaccaacagagaaattaagagttcaccattttggccgggtgtcatggttcacgcctgcaatcccagcacttagggaggccgaggcaggagcccaggagtttgagacctgagcctgagaccaggagtttgagaccagcctgaacaacatgctaaaacccagtctgtgcaaaaattacaaaatttagctggacatggtggcacacgcctatagtcctagctactccagaggctgaggcgggaggattgcttgggcccaggaggtcgaggcagcagttagccgtgattgtgccactgcgcttcaagctgggtgacagagtgagaccctgtctcaacaaaaataaaaagagttcaccatttgggctaacattgtttcccttacatgagaacactggaggttccttggaaaaactggaccaaagaaaatccaaattgactgatagagactctccccatggatagcctgatgatgttaatgaggaaacgaaatactgtcctgtttctgtgtgtggagaaaagctctcagtcagaggccagaccatgaggtgttaactagaacaagaatagcacagattgtgccatttcattccagggaatagacatctacttggtgacagcagaactattagtaatagatgactgccttccttgtgatagtatatttcttactttataccagtatatgagtaatacatgttcaatttagtagatttcatagataaaactagaatggagtctgaggaataagaaagactgaattaaggtggaagaaggaaggcttaaacattgccagagtgggggcaaagctgtcatgagacaaggggtttgtatggataaattactcaaaagttattttaataacaggcaacatagtaaaagttataaaataaagaccgtcttatatttgcagattcgggtgctgtgtttacatttgggaaaagtaaatttgctgaaaataatcccggtaaattctggtttaaaaatgatgtccctgtacatctttcatgtggagatgaacattctgctgttgttaccggttagtattacaatcctgaataaggacagtaatacttagaaaattctaaatattttgttatagatatgctgctgtgttttaaacatgttgaaaatattatcaaaagtgttgttttttactttgctggagaattcttcacaaaataagtcatcaagagcatcttttaaattttaagtttccttagtatatttaagtatgattttctatacacacaactttcttggaatgaatctatttcaatataattttttaaaaaaacctgttaccgtataattttagaaactcttttccacctaatagaaactggttatacatagatgaacaaggtaacttatttcaacacagaaaagcagtgacattttaaaagtatagctttttattgctttgtggtgacctcatcttacattatgtgaaaaatgcttcaattgattatttctttttccctcctaccaggaaataataaactttacatgtttggcagtaacaactggggtcagttaggattaggatcaaagtcagccatcagcaagccaacatgtgtcaaaggtttgggatctttttatcttttcacaaactgtataaagtatttttatgttgactgtgtagttctttaatgtcataaataataaagcttttagttctttattttctgacatttgcttgaatattattagcatttaacttatcttttatatgatattcagaactgcttttatatgttagggtctaaaaatcagattgattttaaatccagggaccacaaaggaagtaatgattttacagtattgcatttgaatatcccccatctttttttgtttgtttgttagtttgtaaaactacttacatattactgttattgtatatacagagaacaaacatatgttagaattttgagcttttctcatttaatacagttgtggacattatgcttctatttggttgctggttttataaaacatacttatcctgctttatatagtgactaggtgaagtaaacgaaacatcgagactagggattgattagtactagtgtaaaagaacaacaggacaaaatatttgaaatcaggagtgttccagaaaatattagatatataatacccttacaaagctttctggatgttatatgcaaaacctctgtttgggtataacctgtgaacatcagctaaacttgaaaggatgatggagattccttgagaagcaataagagcagtattttttatcttcctggctaaattttaatttcagctcaaaatttcagtgtagcttatcatattcatgctgtttatgggaattgttatggaacttttaaagtattccatgtgttcaaaaagtatttattgagcatagtctaaacacctgaggatagtcacagtgaccatgacccttactctcaaatatcttatctaatagacaagctaacaggattgtttagactatgggatccttgagaccagggattctatcttagtcatctttttgcagcccctatgccaagcacgtaggagatgttctttaaatgttttttgaatatgtagatgaatgaatgaacaactttgactgataggtgtatgcctatcaatattggtcttcggtttttcattgaatgtggtagaaggtgagcttgataatggtgatggcaggttaggtaatggatcagattggtgaggaggcagcataatagaatacagtgggtctcagcacatattaattacctgtgaagttgttgtttttttttttttgagacagggtcttgctctgtcacccaagctggagtgcagtggtgtgatctctgcttactgcagcctcgacctcctgggctccagccattctcccacctcagcaccccctccccgaatagctgcaactacaggcatgcatcaccacacccagctaatttttgtatttttttgtagagaaggggtttcaccatgttgcccaggttggtctggaactcctgagctcaagccatctgcctgtcctggcctcccaaagtgctggggagccaccacacccggcctacctgtggagtttataattatatatataaatgcctagccgctgcttcagacccactgactcagattccataggggtggggctaagatatctatattgtattcaaagctccacttgttatgatggtacacaaccagttctgaaaacctctggtttgctcgttaagaacattgactttggaatcagacaagcccgctattaaatctcggttctatcacttagttaccatttgtcctggactactgttcattttcattgctataaaataattgtcccattttaaatatttttagctctaaaacctgaaaaagtgaaattagctgcctgtggaaggaaccacaccctggtgtcaacaggtatagtgctcaacctgtatgatttcctgcctgactttgagaactgaggtctcattccagtaacgtggctttgtaaaattaatagagattatactttggcaacagtaaaattagggttttttaaaatgtcaatggctagtacacgtttgcctttgcaaatatacacgtaaatgtcaaatggctgaagaaaaagcttcttttcttggattctatcatgggacagcatctcctaacctgtgtgtccaccttaagggctggttattcctgttcttgctcttctctcttccttactaagggtgagtggaaggcacccagaaggctgttgatgtgagtgagcataattcccatcaaaatccatatgagcttttgtgtgtgtgtgtgtgtgtttgtagaaattaacaaagtgcttctgaaatttatatggaaaagcaaatgacgtagaagagccaaaacaattttgaaaaataacagaggactggcactacctggtttcaagactcgctgtaaagctactgtaatcaagactgaggtattggcaaaaagatagacaaagattaatgaaacagaatagagtctacaattagacccatatgtatatgcccacttgatttttggcaaagatgccaaggaaattcaatagagaaaggatagtatcttcagcaaatgctgctgtaacatttagacctccaggacctgaccactgagcagtacttcctaccaccttccccctgcccctgccccttgccccgcccctcccccaccaccacttattctgtcttcaggatgttttcactgcctcagctcctctccacctctccatacctttccctttctgaagtgtcttttctctttctcttagccttttaagattatttcttgagatcccattaagtgttaacttctttcatggaacattttgtgactgtgtgttcatttatttgtttgaattatttcagcatctcaccaactctggtttgctccatgtgtgtgaaattgtgcactccaattgcatgtgaccttgtattttccatttgaaagctagtcttgtttccccaattaggtttcgtcttttcctaaaaacaaaaaataaaaataacaataactttaaaatttttactaactcaggctgattttgccctcatttcaccttataatttagcaaggctttaacttcatttatatatttatgacataactaatttatgtgttacaaatcttcattaatttacaacttactggaaatgtttataatctaggcatgatgtactttttatttaattaacagagtaattaacaaacatttttacatactttaaatgagccaaatgctgttctaagaattttacaaatctcaactaattcaatcttcataacaactctatgaagtaggtactattattatcctcattttatagatgaggaaaatgaggcacacagaggttatggcttgcccaaggtcccacagctttggtaagtggtaagccagaatttgcacccaagcagtctggctctggagtctttcctgctaaacagagtgctatagtgccttcctatttagctaggaagttaaaataaatacaaagaattatcatgtttctaattagattcttcttggatttgccttgttttacttatttgtactattatatcttagctttaatggttacagaagttaaaattaatggacacatctcttttaaaatagatttgcattttaaactagtttggaagttactttccttgtttttactctgaattaataaagtgctatattagcaagaaataaatacgttccatgcattctgttcatttcagttgctagttacattctagattgatttctaaaatctcacaaaaatatgtggccttgcttgttttgctttattttgacgatgaaatgaagttgtctcccaaataataggatagtgatagctttcaactttcttcactgttaatagaggaaatcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactggtgagacttgtttctttttcagtctgggacacattcctttcctgtagatcaatatatgccaactcagtaaaccgaagggagcattgctgtttagttttctttcatcgactatctatgtgctttcagaaaacatttaaaatataactttaaatcttgacatactgcaattttatgcttatttatgcttattttatgcttatttgtgcttatttaaatatacatttaaaaagtaattggcaaataagctctaagctatgccgtctgtctactcctttagatattcttaaatattatttttgttgtgtgctcttaaagttatacttgcagttttaactgaagttgctgtcagaaacatccacagaaatctgttgcagcatatgttgttaaaatgtggtttgcaacggtcattgtacctctctgccctccctaccaaaagcccatatgagacatttctttaaaatttggagccaagatcagcttgatcttactgaagctgctggttagctgctttgtttcaagcaggagactgtgtaacatccggtgttactctatcaggaaagtcagagttgtctctgaggctcagtcctttagattttgtcagcccttaagttagcattttgacatccttctttcagttcttattttcatttatttgttttgcattattaaaatacttcaaaaatgtaaattatttaaaatatataaataaataagtcttaataattcctttctaaaatatttttcctagattaactttttctgacatcaaaacccttatcagaaattatatgttacctatttttgagatgctgtacatgctattgtatcttcattctctgaggctagattctgtgttttcaggtttaaattataaggaaaaaaaatgtagtgaaatacgtttcttctgttcttttttcaaaacatcatttccacagtgctcccaagagcaaggtcttccaggcttttttgacctgcaggtgtctaatgtgacctgtgctgtctttcagttcagttgcaggtaggctgcttggaaggaggagaacatttctgtttagaaacatcagaatgggaaagggtgattgtaggaaagggcattctgtctttgctatcgagataaaaatatggtcaggacttaagtgatttacaatcaggctgttctgtgttctttatcattatagaagcatttcacaatataaattgaactcttaagtagctagctggtgtaaatgtcttagtagtactttattgttaagatacataatttttatgaactaataaaataaatggtcttttggaagtataatagcttcagagcctggctaccttttaaaaccttttctcccccttttatttttctttatagaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgatatagtctctggttctatagaaataatgccatggttgtccatgtaatgaaattattttggtctgttttaggtcacagtatttccccatttatataataagagttcataatttcaaactctgtctgacatgatcactttttaggtgaatatagagagctcagcatgggatatagtttcctttggtgggactttctcagcattcccaacttctccctttcctggacccactggcaaccttttctgtcttagttaaaatattggaaatgttgggctctagctgttatagtctatatctatctacactagtaataatagaggaagtgtgattatgactttccatctaattgatgggatttttcaacagtaaaaacacctagaggaaatagtttatggaccctcttagacaaatctttaaatatttattttatacatttactctttattccatataccacaggctcagggttagaaagtggtaattcacccatttcactgccccctaaagttaccaatgaattggtagcagcatgataccaagagagagtaaacctgactttgtcagtatttttcaccactgcatccctggtgtcttgaacaaactgataatcaataaatattattgaatgagggagaaagtgaataaatgatgaattgattgcattccttgaggcaacactacctaccaacttattggcaacttttggctcctggggttggtatagtctgtactcgctttgttcatgaaacaaaaacacaaatgggaaaataagccaaccaaacaacaaaaataccaagtaaaagcattgtatcatatttgggctttaagaaaactgcctgaatgaattgtgtgaatgaactctgcattagccgttaggtgaacaagtggaatagttcatcttaaccaacaggcattacattgagcttttttttggtttgtttttatgcctttttttaattaaaaaaagctcagctttattgagatataattcacataccctacaattcacccatttaaggtgtacaatggaatgtcttttagcatattcacaggtttgtacataaaatgaacttttatactaagcattttgctgagattcatttacatcagctgatatgaactgtcagtaattttcacactagccattattttatgactttaatcacttaaagcaactttttataaattttggaaataactcaagtataaggggttttacttaatatgtatttcatgatagaggaaaatgttgtatagaaaagcattatttttttctctttgtatgttgaatttgtagatcagaaaaaatggattatttttaatttttaatatttgtgggtacataatatatatatagtgggtactacagatatatgtttagtgggtactctctctctctctctctctctatatatatatatatatatgtatatatatggaatacctgagatgtttttatgcaggcatgtgatgggcaataatcacatcatggagaatggggtatccatcccctcaagcatttatcctttgtgttataaacaatccaatgatactgtcttagttattttaaaatgtacaattattttgattgtaatcatcctgttgtgctatcaaatactagaaattattatttctaatttttggacccattaacctccctcctacacacaccccactaccctttctagcctttggtaacaatccttctactctttatttccatgagtttcttttgatttttacatcccacaaataagtgagaacacgcagtgtatgtctttctgtgcctgttttatttcatttaacgtaatgacttccagttccatccacgttattgcaaatgaccggatctcattctttttcatggctgaatagtactctattgtgcataagtaccacattttttcttgttttttgagacagagtcttgctctgttgcccaggctggagtacagtagtatagtcccggctcactgcaacctctgcctcccaggttcaagcgattctcttgcctcagcctcctgagtagctggaattacaggcgcccaccatcatgcccagctattttttttgtatttttaatagcgacagggtttcaccatgttggtcaggctggtcttgaacttctgacctcaggtaatctaccctccttggcctcccaaagtgctgggattacaggtgtgagccaccgcgtctggccccacattttctttattcagtcatctattgatgaacacttaggttgcttccaaatcttggctattgtgaacagtgctgcaacaaacatgggagtgcagatatctctttgatatactggtttctcttcttttgggtatatacccagcagtgggattgctggatcatatggtaactctgtttttagttttttgaggaacctccaaacagaatagtttatttcctaataaaaatacagaacatattactaagatagttatgtttaagacttcctacagatttttcacctactaatatgtttaaatgctcatgttcgtgttttaaattcatgttctcaattcaagttcatattataaattatataaaatattcaatttttagatcttatagataaataaaatctatggagttttcaggtattatccctgattgctgtgtcttttcatctgatatgttaatggttgggtctgagcattttaaccagtgattcactgaattaggtgtagtacaataggggatataagtaaatgagttggggttatgggaactgggggcaggaatttgtggagcaatcttcagatactggagaatagagacttggcagtgtgcttaagatcagaatcctggggaaggtagctgtcagagccaggtagagagtttgaggaatccagattttataaaaattaataggcctaagtgaagtagatataattgatatgaaatgacctatttattctttgtgataaatgttattttattttttatatataaataagaaaaataccttggaattaaataaaacattttatatggattaaaagcactcaccttcccctttaaggaaggtcctactgatagctacaggaaatatcttttctaaccctttacagcaagctcgtccaacccgcagcctaggatggcttagaatgccgcccatcacaaattgtaaaccttcttaaaacatgagatttatgcacagaccttttctttttttagctcatcagctatcgttagtattagtgtattttatgtgtgaccaaagacaattcttccagtgtggcccagggaagccaaaagattggacacccctgctttataggtaaaacattttactttaaaaagtcgacactgtgagaaacttcatcaacttactatgtaaaagtcattttaaatgatatttcttacaataccaagttgattaaaatgtagtacctacccttctgaagtttacagtcaaactataggatgtatagtttttccatgtacaaagcattttcaagtacgaatatatttcatttaatctcccaaccactctgggagagaggtggtggtatctgagattccatatatgcaggcaggtttagaacacagttttattcaaggtgatgctgcgattgagttgcagaatcagaattcgaactccagtcttccagttctaaaagcctgaacaatttctactgacatgcagtttctctccatatacaagaggaagaggaggatgtggtagcaactaataatgaccaggcactgattatgtgttctatgtgcctttgaatgcattaattcggttattcctatgaaacaaccctatcacataggcacttttatccccatgttacaggcccagtgattgaacaacttgctcagtatgactcagtaagtggcagaatccacatgcaaacaaggcagtctgactctgtagcacatactttttgctactgtgctagaccaataactgcaatatacagcagaccatgattggtaacgtaagacatttgatagcagagtcttacgtgagaacaagaaagaaaaaatattatttcttgttaggggcgtcaggacatatttcagagaaagggtggtatttgagattaaccatgaaagatggaaacaactctgagagagacagagatgagggaagaacaatccaggcagagacaaaaacatgtgcagagatatagagacagaaaagtaaatcatgtatttggagattattgcatagttgagtttgtttagaggttgtttgtttagaggttagggatcatggatcctaaaggaatgtaaacccctgaaatgatatgctaaatttggtaggtgcatttttttttttgagctaggtctcactctgttgcccaggctggagtgcagtggcataatcacggctcactgtagcctagaccttctgggctcaagtgatcctcccacctcattcctccgagtagctaggacaaagatgcgtgccaccacactcggctaatttttgtattctttgtagagactgggtttcaccatgttgcccagactggtttcaaactcctagactcaagccatccaccagcctcggcctcccaaactgctgggattacaggcatgagccatcacaccctgctgggatgtgtactttttttatagagctgtcatcaaattcccaagggaggatgtgactcaaaagagagtcaccaggttggggagtagatagaaatatgactggttagtagtccgggaacctaatatggaaggtctcttgtaacagtctgcagtttgtacttgatacatgtattttttttttatttggaagtgtcataattagagccttgtttttggaagatgcatctgatattgtgtgggtatgttagactagaggtaggaaagacatttggaaaacttgatccaggtgaaaattcatgttaaggtgtaaagggaatcaggaatctatagacagaaatggagagagactcatcaggacttaggaaccagtttcctatgggaggcaacaagcatgggaaaatggaagggtgctaacttactgggcaccacttttgtgccagtgtttgctaaatacttcatagaaaactgtggtccataaaacttcattttctgtgcagatcaattcagaaaatcaatatagctgtgtttacagtatttgagcaagttctaagtggtgcatatcttgtgcattggctgtcccacaccttcctgaagttctgtgattttctagaaggactcacagtcttcaatagcgattatacttacgaataagatttattacagcaaaggatacaaagcaaaaagaaaaagtgggaaaaagataagcatctgcagtggagtccagagaagtcaagcttgggcttcctagtactttctcttaggaaaccacacagggcatgttttcttagcagtgaactacagggacatgtgtggaatgtctctgcccagggaagcccattctgttgcttctaggggatttagggggctggtcatgtaggcacctcctgctagcaactggccacagcagctgaaactcaggaccctcaataatgaagccaggtgcacatcatcaatgttgatgtttgtgcaagcagccctgacaaacctaatctggcatagttcattgctctggtatatataacaaaatcattaatcattcacataaagaacactccaggggccaccttctcaggggttgggcaaggatcaatcatggttctctcagagacttgcaaagaataagcaagcagatctgctctgttgtctctttgcttataccaatggtgatatgttccatgtcattcttcagattggatcatatacttacacaaggtttttaaattctactttatagaactcagttaattgcatagaaatgaataagaaagttcttgctttcaagaagttcacagtcataatacagtgtgataaatgtaataaagaagcaaattaatagcgttagtatggacagggcagtgattaagtgtcaggaactccttggtaagagtctttggaggaagtgccatctaaatgggtaaaatctgctatcttaagatttacttaacatatttactgcacacataagtgagttttctaaaaccagtttcatataaagcaattattcattcatttattccacaaatattaagtgcttgttctagacactgctaggttttggggataccatagggagcaagacaaaattcatgtttttatgggagctttaagtaagtaaaagacacaagatattcttcacttttgtgaaagcactaaagtaattttctagttgtttattagtagtggtagtcatgaatttttcatgaaaatgattggattaaaataatcaaggggaaaagaaaatctagctttatttctttatcatacagtaaaaatatctcaagaaaggtcaaatgtattaagtgatccttgtcaaaacttttttttgacggtaagaccagctttttgttcatatgtatgtcatcactaatcactatacttttccttcaatagcagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacgggtatgtgtggagtccactgttctgttccctgcgttctgtggtggctaatgaaatttttttaatgttcattttttttatgttcatttttttattgtggtaagaatactatgagaactaccttcttaatagatttttaagagtataataaagtatttttatgtataggcacgaccattgtacagcagatctctgaaacttatcttgagtaactgaaacttcacgcccactgtacggcaactcgtctttccggcctcccctcaattcctggcgaccaccattttattattagcctctatgagtttgactcttagatacctcgtgtcaggtggcctttgcatctctttccattaagattctcactttttggacctggtgcaatggctgacacctgtaatcctagcattttgggaggccaggagatctcttgagcccaggagttcgagaccagcctgagcaacatgacgaaaccccatctttactaatattagccaggtgtggtctcaggtattcaggaggctgaggtgggaggatcacctgagccaggggaggttgagcttgaggtgagctgtgattgtcccactgcactcaagcctgggcaacagagcaagacctcgtctcaaaacaaaaagaaaaacaaacaaaaaaaagattctcaccctttattcctgtacttaatatacatttctggtctatggaatattttttttaagtagaaaaaaaatgaatcttgttgaattgtttctgctaacataatttacattttcatgaccttaactgtttttttttgagacggagtttcgctcttgtcatgtaggctgcagtgcaatggcctgatcttggctcactgcagcctctgcctcctgagttcaagcgattctcctgcctcagcctcctgagtagctgggattacaggtgcccactaccatgcccagctaatttttgtatttttagtagtgatggggtttcgccatgttggcaaggctggtctcaaactcctgacctcaggtgattcaccagcctcggcctcccaaagtgctgggattacaggcgtgagccaccacacctggcctgaccttaacatttttaatggcaacatattacattatttttagctcattttcagggacaaacaatttttctcatgtatatgttttctatatttatctaaaattgacatttttcctgaaatgccttcttttggagaagctttttgttcaagctattttctatatgtcattgataattcttttctttgtgacatttacaatgtgtagcttggggatttctttgtagttgtatgttctgttatagtaattcattaaaaagtggtatggttttaaattacagataataaaagaaagttaggaccttaatgttacttttgggatctgaatttcatatttgttatgacatgtcatttctcaggattctaatcactgtattgaaatatactcactacttgctaatatgtttactaaattgatgcttccaaattttttcaacattagatttattttagatgagtaatgtacataatacaattaggtagtgaattattattatattttttgcacaaaaaaattaacagtttgtgaagtcaccacttaatctttagtagcccaaagttagaaatgttgtagacaaattttgaataatatccaattctaagatgatatgcctaatgttgccaggtaagtgaataatattttatctttatgtttttttctctgatgttacttttcctcagcttcctgttctagccccagtcgtggttattaagctttagtttctagatggaatcttttctaagttagaaataattttttttcaaaacttatactctaaatttggaaataattctgaggtttaagatgtttttgaattcctgctgaaaaagtgaattttatataatttcgaaaatattctaaaaattaaactttgaaattaatttttacacattatctgaaaattcattctataggcagaaatgcaactttatgtgttatatattttctctagtttatacaaagactatagaaagaattaatttaataggtcattcagggttattttaacagatacaaatgttgattgtataatagtgtctttaaccattcattataaaacatttttctataaagagcaacaagataatctatgatacttttaatgaaagctcaattcttaattttaaattcttaatttaaaataaatgcacttaaggatgatattttcgtgtggttttaaagacatttaactttctgtggactttgttctgagcttaagtataatgtttccagaaattgattgctctctccagatttttgcaagcttacggatctcacacaccagtaaagttttttaaattatgagatgcatctatttgacagacctggaacagttattttttgccactaagatttctactacagatgcaagaaagaagtgtccttgcatttcctttctgattgtggcagccaacattgaatgggggaatacaggagaaaaacttggtaatacagggaaaaaaacatggagagataatttttacagttcataaataactttgtaaacagtgaagagcttgtgttacaatccagagaataatctaaaatttgagtttaaaaaattatgagaaccaatagatggttgtcagcttctgattcacgtttgcttaaatatgggcattgaaaaacatgactgcactatcatatcataaaataaggaacattttcaaaataaaaaactcttaattgtatataataaagggcacctccttaaactgtataaatgtatatgtatgaaaatttcactactttgcctgtttttcacatttctccatggacctgtgagagctttattatgagccagccctggtgaggaacctggttctggagcacagtataggcagaattttaaaaatatttagtcctagctgatgaagaaatggacctgaagagtatattgatcatcagtgtgactaaatactaaactggattgctaagagagttatggaatattttgtaagaccttaaggaaagaatagctaatcacctgttccaatttctttcactaaagaaaagcacttggattaggtgtttctgtgaaggaccttcccagccttgtttttcaaaagtctataactcttatcttaaaaatctattagaggatcattcattaaactattttaaaaacaatttagttcatttctgatgaatttatttaaaacataatatttgcacatgaccgtgatagattagaaaataaaactggttgtagtgatagggtgattatagtttctccttgggatcagggaaaccatggaccactgtggaaaaagtctgaggctggaacttgggacacactaagtgaggcagagtgatatttgtagttttgtaaatcgtccacagcagttaccaacacacaagaaaggccagttgtgagatggggttcacaatgaagtctgggtcctgaggcaaatgagaatttatcttaacttctcagattatgtttggataaacctaagttttctacaggttaacaaattattagttctgaaatcaaatatattctgtgaaattacagtaatattaatctgaagctaactgatcaaatctattttcctaatgtaatattatttattaacattaaattatgttgttaaatgtcacaaaggtgatatggccaaaaattctattggttgttaaatataatgtccttaaataagagcgccttcaatcatttttataaaatagaaactgctgtcatcactaatatccaagcacctgaatgggaacctaccaggatactgaacaaaacttctgtaacatgattcagactgcctaaacagcctcatttcacaggctaattaaaatcagacagcctaagaaatgtagagtaattgttggtcagctagagatagataattgctttaatttacccaatattctactgttaagctgaacatttagaactggaaatatgccatgtgattattatttaaactaagatggttttttaatattaaaataaagatctgttttgccattgcctcaatatggcttcatatctttgatacagcatattttcttaaaggagtagtatctatatgtcttatttatgaagcaaacatttttattagaaaaaattgtaaaaccacatgacaatagacagttatgttttcatttgtaacccccattgatagaatgagttgattagatactttttagaaaaatgttctttacaacagtatgtcatattatgttttcaaatctgcctgaatgttttctcttttaatcctgtcagcacctctgttagatagggattataacatcagagaatctaagtaactcacctgcttgccacagctagtaataatgaatgtttgggttctggcctgaataacaagctcttgcccttcctgctgtaataggagaaactcaatgtactaaactcaaagtacaaaactcagtgtactaaggagaagtgactaatataatcgacactgcgcttcctaatgcagcagccaggagcatgatgtctctaaaaggaccctttcatcaccactcatgtatcctgtttttgtactttttcatttctagaaaacatatgacgtagtatttactgagttactggaagtcctttggaatcacttcaaaatatcaatataaagaaaagcttttcccctcctattatagttgcatttcctagtgaagaagctttacttgtgaataaatctagcatatgccctatcagttttaattctcaagacaattctctgaaattgggttttataagatagattattaaactacttttattttattttattttattttattttattttattttattttattttatttttgagatggagtcttgctctgttgcccaggctggagtgcagtggcgtgatcttggctcactgcaacctccacctcctgggttcaagcgattctcctgcctcagcctccctagtagctgggattacaggtgtacgccaccatgcctggctaatttttgtatttttagtagagacagggtttcaccacgttggccagactcttctccaactcctgaccttaggtgatgcataaactgcttttaaaaggaagaagtttttctgtaggagacactattcacttttttatttgacgtagtgagttagcttaatgacagttggttcttttttattttttgagatggagtgtcgctctgtcacccaggctggagtgcagtggtgcaatcttggcccactgcaacctctgccacctgggttcaagcgattcttgtgcctcagcctccctatgtagctggaattacagatgcatgccatcatgctcaactaatttttgtaattttagtagagatggggtttcaccatgttggccaggccagtctcaaacctggcctcaagcagtccacccgcctcgtcctcccaaagtgctgggattacaggtgtgagccgttgcgaccggccaacagttggtactttttgagccgacgtaattatggggacatttcaggtagttccctgacttatgtgccttgtatcatacctgttacttacctaactatggttatgtataaaagataaaatcatacccatgtcataatttttataatgatgtaccttttcatttttctcttccttcatcattgaaagatttatacttcaatattaagtattcttaaatgtttttttttccccagaggcacttaaccttcactataaaaggttgaacgtgacagtttttccagatatgatggtaacagtgtctgcttccataatccttgtcttgtatttgcccctttcctttcagagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacaggtatggattagaatttctgttatatatttatagaactgggtatattttattacaaaataaattatatgtgaaatgaatgtatctaacttaagtaaaggaattaatggctgagaaaaatggaattccatgtttactattccaaagtataaagttgtgaactttttattattttaattcaatttagaataaatgtaaatgatccaaagatttagaacctcacaataggccgatgatgtcagaagttagaccatagtattattctttgtcagaaaacaggaatctttttgaaattatatcattttgaaggctcttaattctactcaggccaaaaggaaaaatcccacaagcaaaaacttattttaaaacattcttcctattcagtctgacagagctgcattcaggccgagtcagttgttatgtttttgccacctggaggcgttttcaggaatgactcctttccttctctttctacgtgttagagagaagggaccctcagagaccactaagtggataccttcttccactctgtggtatctccttcatgcagggaaatgttcctttgagcccacttctcagcctcaaaactatgtgctgctaataatataggactcagtaaagattctcccctaaatgattcagtcacatatatgtaggtaattgatatagtccacagttttcaatgctttgtgacaaacgggtatataatttcactatttctgtctaaatatgaagtgaagcattggaaagtcagaaatcatctagtgtattgacgtaatccatgtactagtatttctactttttttccttctttttgaaaaagctactgctatgaaaaagctcctgaaaaaactactgctcatctaatggtatctggctagggaaactaggaatcagcaaatgcaagatatactgtttcttcttccccaaagaagctttcagagaagatgacctgcccatgatcaagtatcagtgttcttgagaatgtatcatgaaatagcattatatagaatatgaaaagtattattcattcatcatccactaagagttgttgtgtatcccttaactatagggtcctaatgtcactttatctgtccttactgtcatttttcatcaactctaatcttccactaatagtagatacatactatttttaatctgtcatctaacatacaattcgaatatttagttaaattttcatagtacctttactcctgataaaaagagttatagcacaaataattgaacattaactttgtttgcctttttgttcatcaatcgtccctggagggcaagtggtgtggaattttttttttttttcctccaggactaatgagaagtatgtagtgggttatctgcaagctcttgccagttccccattatagccagtggctcatatttttaaaagctctctgaggttgaaagtgccatcaggcagcttggatcagggtttatattttcaggcaaaagacaatcaaatttaaaaggcaaaccttaaaaaacatttgggtaaagaaatcaggttgaaaagaaggaggaagaagggataaaggtgataaggagcagatataaaagaaggacataaatacttaatagtaagaattgtaagagtctacagcttggtcaacatggtgaaaccccatctctactatattcaaaaattagccagcatggcagcgcgtgcctgtaatatcagctattgaggaggctgaggcaggagaatcacttgaacccgggaggcagaggttgcagtgagctgagatcgcaccactgcactccagcctgggtgacagagcgagaccccatctcaaaaaaaaaaagaaaaaaaaaaaaaggtagtctaaagagtccaaacactgaatagcacttacttacatatttacagggaatctacttatttttgtaaatcgatttttatacttgccaccttactgaattatattattctttctgatgatttttcagttctcttggatttgcttagtatgcagtcactttgccgtcttaaaccagaagtccccaaaggtgacccagttgtttcccagcttaaaaccattcattttccttctaaatgtccttaagataaaacttcaaaaatccttcatctgaactaataggacactctgtgtagtcccttttcacctcttcagactcatctcctaccactctccccttagtgcttcaggggtattagttgcctttcagcttcttgcccgagccacgtttgctcttgattcagaggctttctatgtactgctgactctgcctggaagattctttgctcccttcttcatgcagctaagccctactcatcctttaggtttccctttgaaagccttccctaatccccagactagaggaaaattcccctcctttgaaccatattaacaccccttacttctgcttccctggcacttaccccagttgagatggagcggcttgaagaaaggagtgtgaaggttcgtaatagctgctatggcagtaagcaaaaggactaactggcgagaagtgacaagattactcatcatcattgtgggcccagtttcagaggggacccaggttttggtataggaattagttagcatttttggcttatggcatttacttcaacagtattccacagcccaggagccagattagttaagctaagccagtagtagagattttgtgcatcccccactccccaagtcacatgacaacgtttggagacattttttaatggtcatgactgcagaatggagttgtcctactggcatttagtgggtggaggccaaggatgctgctgaacatcctacagtgcacaggacagacccacacgaccatgaattatctggccccaaatgtcaataatgccaaggttgagaaactctgatctatcagtgacctcagggaaaaggaaaatagactgtgttgggatgtaggggtcagaatacaagcatctccttctccttcccttggaatatatgatgtgtatctcaaattctcattctgtattgctgctgctccacacactgccttgcgtgacaggtcatcaacttcacaaaccaccaaggttaattgatttattctcagaatatttattgcctgatgttacatgcaggaccacagagaccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttcctttttgctgaaatcttgtctcttctgcttcattctcatatatctgttgaaagctgggactgtgccatgcccgcaggctttgtatcttgtgtagcacccagcagagtaccttgctcacaatagtctttaataaatatttgctgaattaaatgttagactctcaaatcctgcacaacagaaagtctgataataaacaaagcgttttggcagggcacggtggctcactcctgtaatcccagcactttgggaggccaaggcgggcggatcacctgagatcgggagtttaagaacagcctggccaacatggtgaaaccctgtcactaatgaaaatacaaaaattagccaggtatgatggcacacgcctgtaatcccaactacttgggaggctgaggcacgagaattgcttgaacccagaaggtggaggttgcagtgagctgaggtcgtgtcactgcactccagcccaggtgacagtgagactctgtctcaaaaaaaataaaaaataaagagttttgaagatacggttttttggctaaattttcttaggttaaggatgtattatttcagtgtcacgtcaccatcacgcatcatacctgtattgtttcttaatatttttgccagttaagtttagacttttgaaaattctatttacttgatgataatactgaaatttgtcctccagagactcagtgtctcataatatggaacactttgatttattgatttgacagtcatttaatgaaagcctactatgggtaagatagtgtgctaagtataagaaatacaaagtactggtcgggcgcggtggctcacgcctgtaatcctagcactttgggaggccgaggcgtgcagatcaactgaggtcaggagttcaagaccagcctggctaacatggtgaaaccccatctctactaaaaatacaaaaattagctgggcgtggtggcaggtgcctgtaatcccagcttcttgggatcctgaggcaaaataattgcttgaatccgggaggcagaggttgcagtgagccgagattgtgccattgcactccagcctgggcgagaagagtaaaactccatctcaaaaaaaaagaaaaaaaagaaatacaaagtattgtatacagtgatgaacgaaataaccaggacctcattcattgaggacttattcattacagtcttataatttttaaaagggatatacaaaaatatatataaatttaaaattttaaagtattatgaaggaaaaatagaacattataaagtatctagaacctatgtacggaaaatactgcactatgggttttttttttagcattttcttgaaaatgatttatttctcaaaattctttgaatgctgatttcattttttattgttctgtcatcacccaagtaatcacgcatacttgcatttattttcctctaaggacttttaagcattaaacttagaaaatgttcatataaagaaggcttagagacataattagctcaagagactgatttatactttaaaaaaaatcttctagtagaacttctctgagtaatttttcacatttttaatgttcttcccagattaaaatacaacattttctaactgtaaggagaaatgtaatttgccaagtatttttttctctatattattttaaattgaaagtaaaatggtggattaaacttgttctaattttcaatcacaatgtttaaagaatatgtatggtaattgtgtacctattgtatacatattgtgtacacattctcattgtgcacacacatacgtatagacagagagattcaccaagccagtctgtctaggaagcctaccactaaataaatgtcttacagctgataactgttaaaaactcatttgtgtttgaagccaatgttgatgagtttttctgtggatttatgctgcaggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggtacaattgtggcctattctgtataatagtattatctagcactgcaaagaaaactagaagaaaaaaatctgttttctttttaaatcaaagggtcttctcagataaatttgctacataaaattattagagttgagtgctaacaaacttttagagttaattcagaaaaattcagaaaagcttaatgctttttttaaagacacaaattagaaaatttaaattatagaaaacttttgcatatagacaatggtgctataaaagcatccttttatagtcctattttatcacctcacattgaatgctgaattgttttttcaactgcatgtggactgactttcactttgttatatgcttttttttattatggtagtaaaaatacaacaaatatacccccttaacagatttttaagtgtgcaatacggtattgttgactataggcacaatgttatgttgttcagaaatctgtagaacttaattatcttatataatgctacattcttttgtctttcagttaagcctcatgagcagtgggagcttatatactataaacaatgaaatgggaaaacaaaggaataaggacttcaattagagagaggaaatattctctcaattaaatttagagattttccttctgtgttttaaaattattgttccaatgacatatatatatatgtgttttttttttttttgagacagagtctcactctgttgcccaggctggggtgcagtggcgcaatcttggctcactgcaacctccacctcctgggttcaagccattctcctgcctcagcctcccaagtagctgggactacaggcgtgcaccaccatgcccggctaatttttttgtatttttaggagagacggggtttcaccatgctggccaggctggtctcgaactcctgacctcaagtgatccaccagcctcggcctcccaacctgctgggattacaggcatgagccaccaagcccggccccaatgacatacctgttttttaaagtaaatggcaaataatttttgaaggtaacattccttttttgaaaattactataagtttcaaaacatgtttttttgaaggttcatagcagttttatttgtaatagccagcatatttcttttgaagtaaaaaggttaaatctggtgttttattatgaaaaagcatatatggaaaagttgagaaataccccatcagtgttttgtagttgttgttaatttacatctcctaagtaattttttgtttcttagggagtgtagagaaaatgcacacacacttttccctggtcatgtgaaaaataaagcttccaaattgaaatttagagcaactaagatacagagacaacagagcaaaatgtttttgagcctttggggattattaagaagtaaatgttgtggagtgttggcatactttgaactttctcttaaatattttagcaacttttaggaaagtttatatcaatattaaatatataacatcatgaaatagtttgtttaacctgcttattttaaaggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccaggtaacatttgctactctgtctgctctcaggataaatgtgccttttattcctgtagtttttatgtttatcttaagatgttttctccagttatttaaattgttctctccctggttagagcctaacatcactcatttgaactcaaatccgggaatatccttacaagtagaaagcaccatcagtgctcctaagactgccatgtaaccacagcagcatatctttatagagcagtggataacagttatagtacattccttaactttatcccctttaaaccctgaaaccacttgatgaacttaggagggagttatagtcttcattttagagatgagaaaagcaaggcttgaagagatcaagtgacttgcccaaggtcactcagcttataaacgaagtggtcagaatttgaatacaggtcttctggatctatgtgaaattctgtatttaggcagtataacatagcggttaagagcatggactatggagttaaactggggtcaaaagccagttttgacatttactagctgtgtggctgactttgggaaagttacttaacctctctaagcctcagtttccttgtctttgaaatttatttaataatactgacttcagaaagtgattgtgaggattcagtgagatcaggcatataaaataattagcattgagcccagcacctctagaaacacctcagtaaatgttgttatgattaatattaatacctttgcgtcactacctattagatacagatttcatgttttaatttgtaatcccagctctttcactattctatacctattctaagtaattttctttagagatatttgtgtatcttaggagtgtctgtatgttactgcaggacatctagagagggaatattctctcttaattaaatttagggattctcctgtgttttaaaattattgttccaatgacacatatattttttaaagtaaatggcaaataatttttttttttgagacggattctcgctttgtcgcccaagctggagtgcagtggcgcaatctgggctcactgcaagctctgcctcctgggttcaagccattctcctgcctcagtctcctgagtagctgggactacaggtgcccgccaccatgcccggctaattttttgtattttttttgtagacatgcggtttcaccgtgttagccaggatggtctcgatctcctgaccttgtgatctgcccacctcggcctcccaaagtgctgggattacaggcatgagccaccacgcccggccaatggcaaataatttttgaaggagacatttcttttctgaaaattactgtaagtttcaaaacatatttctttttttgaaggttcatagcagttttatttgtaatagccaacatatttctctatttgataggggtaggacaagaaaccaggaccaggagatcagaaagtaagcagtaaatttgaaattaagaagataaacctgtcatcagggactaagaatcagggactaggaacagataatttgtgtatctttgagatcaggaagctaggcaaagggttgaggtaataaaggattgggaactcaggtaagaattgtgggccatgggaatgggatattatatataactaggaccttgataatgagctgatttcttgcacctgacccacaacttttgtatgttttcttttgaaataagatcaatgtctaatggtactcttcagccctggacatggaaaaagtagtagattctggcaagcagtatgtagtgtgtacaaggaaaaaatacatttatggtttagggaaaattgtttctcagtcccagagatttgaatgtgaaaatatgcatgattttgtagctagatcaaaaggaaatgccatctcttgtctttttgtgactgctaacactctcttaagaaaacattttggaagttgtatctaacatatactttaactttttctaaatcattcacagacttcaatctttataatggaggaaagtggatcaggatatatcttactaaggagttgtcatttaagctaaaggataagaaagagatggctacacagggagactagatgtatttcaggcaaagaaaataatatagacaaaggtttggaggcagttaagaagaaaaggacaaccagtggggctagaaagtgagggaaagggtaagataaagcagtattggagaaagagatggtgaaaaattatttacggttttataggccgtgagagacctacgtgatatgaatgtttttcttaagtgagatagaaagtcattaaaagattttaagcagtagactgatgtgttccaatcctatttctactttgagatgattatgatcacttctacctccatatagattatacagaggccagactagaaataggaagaatacttgtgagccctttgcaggagatgatagtgtatggaccaaggtgtttgcagtggagatggagaaaagaaaaagaaaagagggaagatgtgaaatacattatagacataaaaaccaaccggacttgctaaacttattaatgcaccacacatacgtgtgaattaaagtgaggaatcaaggatgattcctaagcaagaggaagcttgacacatttgaggaagaaatttaagaactaagcctcaaactaagaacacgtttgaggaagaaatttgagatctgtgaggcatccaagtagaaatatcaagctgattgttgaaacacaagcctaaagtttagaagagagccctggactagaaatataaatttggaagccatcaacatagagatggtatttaaaagagatgggcatggtaacttatgcctataatcccagtattttgagaggctgaggtaggaggattgcttgaagctaggagtttgagaccagcctgggcaacacagcaagaccccctctctctatttaaaataataataaaatccatggatgttggtgaaatcacctgctagagggtagagtcagaagagaagagggcccagaatgtatccctaagaacatctaacatttgaggggtagagaaggaagagccagcaaagaagccttcctcagctttttcagccagtaaggcaggaggtgggaaattagggcagcgtagtgtcgtgaatgcaaagtaccgctcaaagatcaagggaaaatagctcaaagaagtatccaatggatttggtataatggagtttactggtgacctcgacaagagcagttctaggggaagatcagggaagaagccagagtgttaagagttgagttatgaatggggaatgagggattgaagaggagataagatgagcagataattcctttgtctatttgctgataaagtggagcagagaaatggtctggcagctagagggggatgtgggctcaatagaaaatattggagcacatttatatggtaatgaatgagccagtagtcctggagagagagcacagaagagagaaagtataaggaaagttgcaaagctcttgcaaaacaggaggggccggcatagagagtggtctttggtaacaggaaaaacacatcctacattttaacaggcaaatgagaacttgggtacaaatataggtagttgtgtatgtttgttggtgagaagatcaagtggatcggatatgatcacttctgttttctcagtcaaatctgaggcaaggccatcagcttaaataatctgctatgtattttccaaacctatattctctgccttctccagtctatcctgcataacactttccacattgatcttcctcaggtgcaattcagtttccatgtgctccagtgtcttcagtgaattcctaatatttatgaaaataattgttaattttcccatataattccaaattctagctttatctctcagtagtcttttccttacaatcttcatttggtaataggtagtattatggtagtaatgtattatggtagtctacaaataatggctcgtgggccaaatctagctggccacctgtttttataaataaagttttattggaacccagccatacccattcctttatgtattgtctgtggctgctttctgctacaatgtcataggttagttaggacagagaccatatggcccaggaagcctaagatgtttactatatggccgtttagagaaaaagtttgctgactcttaattttgatcagactgatctcttcagtctaacttagtggaaagaacaagagctgtggagtcagacagacctaagattgacactggataccaacggtcactgaaacttaatttctatatttacaaaatgaggatataatacttaaccttccttgttgtcgtagggtcaatataacatatataaaagcatatgtttctgggatttggtaagccttcaagacaagcttctttcctctactcatttgctgagactactgttctgctgctttattaggaatgggcttcattgtcttccccttacacctccatctctgcccctcagaattctaattctactcatctttctatgtacctctgtagtgaaacttttcctgattgccaacatacggatgtaatttctcatagactataacttcattaagaaatagcaattacaattttttaacagcaaacaacaaaattgcaattgctaatacttaatgaacttattagtatatgtatacccaaacatgttttataccttaaatatagacgataaaaaataaaaaagaattagcaattacttatgttgctattctgcagattaccacacatggaataaataccaaatagttatttgctcattcaattcagtggatttaaaggggagggatcagtgtggactgtcattttttagtgaagacttcattaaggagctacgtccaaatgtattggtgatcaatgagggcatagtgagaaactgagaaaaatgtaaagtcaagtagagcctatgacttttaattatctactttatgatgtaataaccttgcagttttctgtgaaaggttctaggtgcttatactagttatctgttgctacatttaaaaaatgaccctaaaacttagtaggttaaaacaaaaagcatttattatttcacacagtttctgagagtcaggagtccagcagcagcttagctgggtggttctggcccaggttctttcatagggttgcagtcacactgtcagatggggctgcagttatctgaaggcttgactgaggctggaagatccacttccaagctcattcacatggccattggcaggaggcctcacttccttgagatgctcacaacatggactcctacagagcaagtgattagagagaaagagagggagtgcacgagtgtagctgggggtggagggggagagagagagagcaagagagccagagcgagcacaagtgcgcatacgtgtataaccaaaacagaagccataatgctatcacaattacatctgctttattttactggctgtgcacatacggaccaacctggtataatgggcaagggaactacacaagagtatgaacaccaggacgttgtaggtcattggggcccttcttaggactagctattacagtgcttgatacctgggtagttatttatcccaagggaatagtgtttgcctgttcatatgaatgaaacaattgtaatctaattggtgtcaatgtttttaaactttcacaaagattttaaaacctatgtcattgtgaatgaattcttttcaatttccctgacatgaggttaaaggacttttagtaaaattatacctacactttatattatagaataatttctgttttctgtccagttgcctttcacttttctgttgaaatctggatttcctttttcccatttaatcattcagattatttgctagatgaaatgaccaaagaagcagagatagataattcttcaactgtagaaagccttggagaaactactgatatcttaaacatggtaatgatttcctatctatttatctaaatatgagtttgaattttagttcattgtgtatgtgaatgtgtgtatacttcctatactcttatatgcatgaaagcgtctttctcgtttcttactttattttttaaccaactatattgaggtataattcacatacaataaaatttgttttgatcctcacattattagtatggcaattgagagcggattctattactatctgaactgttttcccttcattttatatatatatatatataaaaaaatatatataattgaaaatatactatatatttgtactatatacaaatatatagtatatatactgtattctttttataatatatattttttatttatttcagacacacatcatgagcctgaattccaatgaaaagtcattaaaattatcaccagttcagaaacaaaaggtataatatgaagatttattttcgttattgttggtgagagcagtttaagttaattttttggatggtttttggaaagaacacaagaaacgtaagcatttacttactttagaatttaaaagacagagggatacaatgtagataacctccattttgccttgttctgatggtatgtattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaattccttttaagctgacatatattttatactttctatagtctttttaagtttaggccctaccaggcctactttagtaaatgagaaaagatttattatactatttctgtgtattaacttgttaatttttaacttgtcatgttttaataatttctttggcacaataggaacctcttcctaggcctaactcatcacaatttataaaatttgaattagtgaggttttactatccagagacccaaattcattagatatttgcatccattagcttgtttgtagaatttagatcaacaatttggttttgccttattttgtccagcaggaaattaattttgtattgttaatgtattattcaaatgtcagtgtttgatttcatagtttttgtacaaatcttacattttacacttaatattctttccttagtgttctttcatttatagaaattattgtaattaaataatataatcaatgcaaggaagaaggtcaaaaatttgaaaactcatgaagattttgtttagaaaagaaaaatatattcattattatttagtttatagataaaaaacatctcatgtgcagtttcttcagttctaggagtggactattcatttttttcaaattttacatttttatttattttgtgaattttgtggactcaaaagacaaatgaaaatttgaaaattaggccaggcatggtggctcatgcctgtaatcccagcactttgggcggccaagatgggcagatcacttgaggtcagaagttcgagactagcctggccatcatggtgaaacctcatctctactaaaaataaaaaagttagctggatgtggtggcatgcacccatagtcccagctactcaggaagctgaggtgggagaatcgctggaacccaggaggcagaggctgcagtgagctgagatcatgccactgagctccagcctaggtgacagaatgaaactccgtctcaagaaaaaaaaattgaaaattaaagatgatcgggaaagtgggaaaaatatactaagctgtactatgtataagaaaagtgtacatttttttctttgaaatggaatttcgctcttgttgcccaggctggagtgcagtggcacaatcttggctcactgcaacctctgcctcccgggttcaagcaattctcctgcctcagcctcccgagtagctgggattacaggcatgtgccaccactcctggctaatttttgtacttttagtagagacgggttttcaccaggttggccaggctagtcttgaactcctgaccttaggtaatccacccgcctcggcctcttaaagtactgggattacaggtgtgagccactgtgccaggccaagaagtgtacatttttaaatagcatcttgcaaaattaatctcgaagttttatgtaaggattgattcggattgagaaaagaggcagagagtaaatattgatggtattgtgattaatggcaaaattatggcaggtagtaagaatcgaaaattaaacacagatacatgttactaaatcaaaattagatgtatcacagactagagagtggcacaaatgatccttaaagaaaacaaaactttagcaaaatatctggtaaaacttgctattttgattctcctaaacttataaaaatgtaaaatcttggcagtatttaaagtagataagttgtccttgtcaactaatagtagtatgacatatgataattacttcaaaaaatttacagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgtatatagtcagaaattctttatgaaaagataaactgtctagtattagatactgaattttagagaggctagatttccactagagtaatttcaattgtcccttaaaattttccgtgtacataatgcagctaatttatctgatagtttatttgtggctcctttttcaactaatttcctttcatagtcccttttatatcctgggcatgagagatttcttatacttagttttattaaggaggattttgatgagaaacttcctgtgagttttgtgtagttgagttcttttgcacagttgattctctgagtgagaaagaatatgaggaaaaagtctagaatcgtatgaagtaaaggatttcctaggagcaattgtaagttttgccttagctgcaaggatctctggcagcttcccctaactaaccaaatgtactgatttggcattgcattgctttaccgaattcgaccacattcattaagggatagtagaaaagaattaatactatgataaaaatatatgtgccgaacatgattatttaaaaagtagatttaaaataattaagatggatgacacagaattcataaagaaaaaaacctccagggaaatgagaaactcttaaactcaagttattaatgtaatagctatgagcattcatcttctactgaagagataatcagccagtaatacagaaacaacgttctaaaatacacccatctcagtattaaacctggtctatatgtccacgtttaaatagcatttcttcacatttccctggccaaaaacattttgtgctctttagaagtggtagttcatgcaagcattgttttctagtggagaacactggcctccctagtcactttgagaccaaagcccttcttctggttttgtacttttgagctgtctgaacttgggctagtctcttagctttgcagtcctcaatttcttcatctggaaaattatagaatgagaatgagtgacctaagggattctataggaacagcagttgttcattaccagctagagctctgtcacacccagattttctgcaattcctttttcctcaataaaaaatcttaagtctcgtcaccaaagcgaccccacattcaaactaactagtagttatactaaagtaaacagttatcctaaactactaagcacacactaactttctgtgcccactgttgggcgaacatttatttaatcacatgtggcaggtctagtaccctcaaaaagtttatggagaggagtgtattgtgggttaggggtgggttggggtacaaaagacccaggtctatccaggctttcatcgacagaagtgatttacatgtttgtaaattttatatatcttaggagaaaaaaaaggaagcttaagaatgagaccactttgtccctcatgaattaacacttggttatatagattaaaataactggttccttctttattgttcccatctgctggttgttcaggcttttatagtagtttattactgatcattattgagggaagtgtgagtagtatatatagaatccattgagttacatttcctaatgaggactctggctgaaaaagactttaaggtaagctgcaaaggattacctaccacagaaactgctgctgctgctgctgctgctgctgctgaacagcagcagtcaaggtgagtgcaactgaaatgtcttctattatttcactatagagaaacttgctatacacttacatagcaaaaataaaatgtgaccatggaagaaggaaaggccaagcttttcttgtttctgacctggagaactgagtagaaagagtactattcagcaagatcgagaataagggagcagaagcatgtttgggagacagttttttactgttgattttagattgtaggagatgttcaggaggcagatacctgtatggatctggagctcacggagactgctgagtatcgccagctcatagatgtagttaaaactggatttgactgaaaggaagtgttcctaatgtgaatggaggagagttgaagacagaattcagagaaatgtcagtaggtaagggagaggttgagaaagtgaagtctgagaaggaggtgtgggagcatacttactaggaaagagagataccacccaagccaaagaaggggtttcagagaggaaggagtggtagtagctgcagagagagcctctaggaggcagcctagtagagggccaggggcagaacccacattgccaggaaagaatgagctccgggaaatctgctctgcagaggaatagaatcagaactgtgaaaattaaatatcagatatagatatttaatttttaaaatatttaattttttaagcatatttctcaatttaggaagggagatgtgtactccagagactttggttttctggggaaaagatgataaattttgttcataattaatatatacataagaatagagtgttattgatgtgagcttatgaaccaaaagaaaaatctgcaatgctttaaacattagtgaggcggagaaaaaaaacatctgtgagaacagccattattatcctcaaattaaatgagcaggtttggaaacaaacatgggctccaaagtccagtagaactgagttaaaatcccagccctccactgatgagctgtgtggacacctagaaaagttgtggtggtggtggtggtggtggttgttatttgacctttctgagtcttatttccctcatttgataaaggaagggacttttgacgattaaattacctaacacatgaaacatgttataggcactcagcaaatggtaacctgtatcactctaattatactctgtgatcacaccaaggtaggtgcaaagctacactcatgaatctccaggtcactgactgatgtgcgtgagtttagtcatgtgaacctgacttttgtttaaatgtaacataatagcaaaatataaattggcttatagaaatagatctgtgggaataaagtagattgcaataatgatcatgcttaagtataaggtggagtgaaactattacacaccatacattagtcaataaatgcccctaaatatttaaagtgtgttgaaacgctgatcacactcatgtggttagccgaaaatttaggtgtgttttctgtcactgaacatttccctctgtgtcctaaccttgttatcaaaataaataaaaataattagcacataaggtatagtcgtggatcatgcatttgtttatggacaacaagaaaatcttctaaggaaaaagagtagagatagtaaagaataaatctgaaaatgagaataaaaatgctcgccagcaagatattctatactctgaacatttatttctgtaggcctgcctatcaaactggaatgtattcagtggtgagaatacaggattaggaatgacataagggagtggtgcctagaaagaaggaagagtttaagagattataaagtagtatgatcagccaagaatttggagatcacaactggcagcccatgggtgcagtctggcctgcagacttattttgtttggtgcagtttttttttatttaaatcatattggttgccaacattgaaatgtcaggagattttacatttaaaaagtttctcagccaggcatggtgactcacacctgtaatcgcagaactttgggaggctgaggctggaggattgcttgaggccaggagttcaagaccagcctgggcaagatgataaaaacctgtctctacaaaaaaattaaaagattagttaggcatggtggtgtgcgccctgtagtcccagctactcaggaggctgaagtgggaagatcgcttgagccctgaaggtcaaggctgtagtaagctgtgattgtgccactgcactccagcttgagtgacagagtgaggccctgtctcaaataataataatgtttcttggacttttggaaagcctgggtctgggagcatcacactgtggcaacactgacctgaagctgagctgaggctggcacccctctccccagttcccatggctccttccctcactggccttgatgctaggctcctggctcacaataaaaggatgtatagaggacacaaaaataagtggacgttttaaatgaactattttccagtgataagatctgggacattatgggaaaaaaaagtccaaacttactgtttttcgacagtcctcaatgcacactaagaattctatcttactttttatggaggggcctctacaaaattatttatacttatatacaaatatatagtatatgctcatgttatttttctctgtaaataatctttttaatctttacacaaaccctctgaggtaggtattgctaatgttatttttccattttacaggtagactataaaatacattcactgggtgccatgctcaggccatgagtgattagattaaggcttggaaagcagtgcttagggctttgtatttaatgcccttcccaccccatactgctgtttccatgattttcagtgtagttaaaacatgaacttacaggttaacttttcctgtccaaaaaaaaaatatatacttgaaattttgatttttctacctgatataacttaaatacaaagttttatgctatattaacctatctgggaaacattttctaccctacatgacattgaagcatgtcagaaattctgaattatagcacaaaattttatactttatagctctggtttgttttattacttttaaaaaactataatacccacggacaaaagtgcctatctcatacatgtgtccctcaatatatttttcacaaagtgaatacacccatcacaaactgatcagcatccaaatcaaggaaaaacacagtaccagctccctcagaagcttcactttaacccctttcagtcatttcccactctcagccccaccccccagcccccatcccagcattctccttaaagcatgcgatgtaattgtgttcttaagtaaacagaaacctcagtaggaacctttgctctcttgttctgttccttaagaaatatgaaaagtgttgccttgggccagaccagagtctgcacctgactgtgccatgcctgaccaatgaaacaaagggtccttttgtgagaggtcaggcccattcacttctttactgtgatcctaacgcaagacacagacatatactgaccatttcagactacctgtttacatcttcttagatggttctagtgccaagaatgtacttaaactttactctttctttttataaaatgacagtattctgccagtcactcccaaattgtttcagtttaaaaggtaagtgctttctgtgacttcaagtagtcgtccagatgtgtttagaataattttaaatgtgcttagtctgtgagtgctatgatgtgatttctagtgaaaatgtcattttctaatagctttctcaaatttagaaaatgatatagttccaaaagttcttcattgttatagattgtttaaagttaatgagtaaaattgtagtttgttatgagtgttttacttatttctaaaataaggtaaaactcccacgtgtctttttataatagcatgacattatcctgtggttacatgaatacctcagttaacaagcccagttggagttgacccaggtgctaggttagccaagcttcccaagtaattgaggattatgctgggaacacagctcactgatccctccctctgtgaaaagaggggcatagtctgaaattccttgtctcaggagcactgttctttttagttaacctttcatttatgtatatttatgcagacaactatcagtcataagtcttaaatctagtaatcttcccattccctttcaaagtgaagttgtttctgataattttagctacccataatgtatacctggctaggcatgatacacaatataagtcactcaaaaggggaaatcaggctgggcgtggtggctcacgcttgtaatcctagcactttgggaggccaaggcgggaggatcacctgaagtcaggagtttgaggccagcctggccaacatggcgaaaccccgtctttactaaaagtacaaaaatcagctgggtgtggtggtgggtgcctgtaatcccagctactcgggaggctgaggcaggagaatcgcttcaacccgggaggtggaggttgcagtgagccaagattgtgccactgcactccagcctgggtgacagagtgagaccctgtctcaaacaaaagcaaaaaacaggcggttggaatcatgcagacaaaaacaaagcttaaaagtaaatgataactacctcatgttaaccctacccagtctaatcaatcatcatttgaaatagctgtctgccctggtaccatgttcctttctcccacattcctctcttgcatacattgcctcatgaccttggattaacctaaatctaattcttcctgagtagcttctgaaactctttttaaaatctcaaagctttatttacttagggcttcctgtcctcagtgggaatgctattaggccacgcctttgcaattggcctgaggatgacactaatgtttactattaaggtgtactgtataaacatcctcttcctagcctggactctcgcattttatatttttaccagaagaaaggtgagttaaattttagaggcattattttccaaccacctactaaagattctgttgagtatcagtcaggctttatccttagccagacagctactagaaagctgaccatcaaaagctaattacagtgttgaaggggatatggtctgaagcaaatattgccaaggtgaactttgtacaaatgttatttgaaggagtaaatggcactgataactgcttcacatattttagaagcagttataataaacttaattataataaactataaagttataactttagtgaagtgtgtaaatgaaaagtatgggggggaatctaatgagaaacctaatatcttaatgacaatcagagtatttcacccaaaattagaaagttaaaaaaaaaaaagaaatctcagtgtagaataaaggctgaaactaatattttctgcctatacttaataagcattccatgatttactatcagtctatcaaatccatagacagcctcttttatcgtttggattagctggccagtagccagacagaacaagttctgcctctgtttggttttccttctgcttttaataaccatgagcaaaccatttaaactgtctatgttcctttatcttttttcctggaatgtaaataattatacttatcttcctcatgactgtcagtgaatcgtacttctgaagtgattctaaatccctatattttggaaaatgaatataatatatagatatgattatgttataatgctacagtagacagaacgctttttaaacttttctcaaggttgaaagcattgtgagacaaccaagaaagagtatttattttttttttccattgtaaccttgccatgggtgctagtaagaattttggaaatcctagtcattgaaatagagtggcatgcgtaaaatccttgttaatacagtaacttgatattcagcatggactgtacagtatttttttcttcggcttcaatatttgaattaatattttcctggtttttttagatgacacaaattatttatgacagcaatatcaaatccctcgttttttaacaagaaaatcttactcttctctgatggtcaattttgtcacaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaaggtatgatgatagatgcttaaatcctgagatcctgggagaaaacatatgggttctctagtttctgcagaggacagattccagttgcctttgggatcagaaatactcccatgaatacatgaatacatgaattcatgtgccataagagaaaggctttggcttatttgtgaactaagcaaactttgtctctagcacactttctagaatgctgcttggtagcattctgcctcccgcatgagtggaagtagaatggtatgggccaggatagtacaccgttgggaaattaaccaagaagttcagcactcagtccttgaaatgctgaaagtgcaaagttaggagccctggcactggtggcagaaatggggtgtgtatgtgtacacacacctgtgtatgtttacatgtgtgaatgattgaaagttggtcacagcagtatttgaagttgtgatcagttcttcaaaggtgcagtctagacaaaattatgtatagaaggaataggagaagatatcactaaggaagcaaaaatcaccctgaaagtggagctagagaagcccaaaacataatctcttccattggcagttttgactgagagtgaccttgctaggagatagtttgtaggtttgaaatcatttgtttgctaacactactctggattaacttcagaagtatggaattccgcaacccaaagtgaatgacgttgtactgattcatctttattttcattttttgaacctctcatgcagaacactgagtcataccttctagtatgaaacactctcatcattggtctgttgcaaggctcttctcatgtaaatgtattctcttttagctccattccccttcccctttttccctaacatagacaaccactgaaacatatttgtcattttatttgaatgtgtacttgtgaaacatgttttgtgtgcatacatttttaatttacaaattggtattgtggtaaaggtcattcttttgcttggttccttctttatccaagactcctttctctcactaagaaaaaaaatattctagcagttactgttttatttcagaaggagaaaatgattctgtttatagggaacatttatgaattcaggttagggtggtccttaagattatttaacatagaaatcattaaataccaatttgacattgtaaaatgttgagacaagttgtatgccaattagcgttcatgaatcttctttgaggagaattcttgagtcatacagtttttttaatcacacaattttaagctaggaggacatttgcaatcagtcagcatctaaggcccctcactttacaagagctcagcaaagtgaagtaattgtcacatgtttatgtcattagctagaggcagactctagaacctgcttaaagattcagacttaagttttctagaacagcacaaaaatattttttgttatattgctttgttattgtttatagaaagaaaaagccaacctagaggaacgggccatttgtgagtacaatgaaaacccaaaaggtatgagcacatttgataacatacatatatacatacatacatacacacatatatatgtgtatgtatgccataattgggtaattataagcttacatataagtttacatatatgctataatttttactgtcacatgatcctcataacaagctatgaaatatgtgatacagacttatctgttcttatatataaccaccacagcttcttcacatacaaatattgcattattcatggctacttatgtgtcaatgttaaggaattttttatttttttttgagacagagtttcgctcttgttgcccaggatggagtgcaatggcacgatctcagctcattgcaatctccacctcccaggttcaagtgattctcctgcctcagcctcccgagtagctgggattacaggcgtgtgccactacacctggctaatttttatatttttagtagagatgtggttttgccatattgtccaggcgagtctcaaactcctgacctcaggtgatcctcccgcctcggcctcccaaagtgctgggattacaggcatgagccaccacacccggctggtgttaaggaatttaagtagcctttttactaccttttttctctctattaaatcagtattattaaatcaagcttttgccccaaattccaatttatatctctagtgcacactgctagactccattgcccaaccaagttgggactactgggctggcctaaagccacaatggccacccagttatttacccccgagggctcagacctgagtgtcttaccgtagatactgaagagaagtcctttcccaagcctacctatcagtgtcagagagcaggtgctgtggaatagaggagactgtgattgcccttgagatctacataatctagacacaaatcatctgtgtttctgtagtatgactcccacattgtttccacaccatcacacggcagtatgattgtgttctcataaaaaaataactatctgtaatactggatatctgatctaaacttaagctgaagaatgaatagtttccttaatcctgttccttttaacttctgccataagagtagtaagttttagaatattttaggcaagtgttaaaaaatgtatcacctataagtattcttaacatatagcctaaagcactacaaagaaattaaatataagcttaaaagtagttgataatataaaattaaaacaatgcatatgcttcacaagtatactttgaagataattattcagatatagaacatgtggattaatttgaaacaccaaaaaatagcatgtccatttgagtacaaagaatgtaattataactaggttaatttttaaagtaatttgtattttacagaagtcttctctaacattgactattacctttgtagctatatttggatactggtcatctaaacatttacaactttggtgaggtcattctgggcttttcactttaactcaacttttcaggaaatatgcagtgtagatgttgtccactactccaggggtgagctcttttcgtattaccccacaactcagggttcatagagtttcactgagagcatcaggtcttgtctttttcctattagttaaaactagtatttctgaatgatccaattgtaggatacatgcttgatgatgcagatagcagttcattagaaatcctagaaaacagtgaaacaacaccaagcaaagacatgaaaaaaacaaagaaggtaagtgaaatgaattgtcttttttgatccttttgaattcaattgtttgttttacttttcatatggcaatccacataatttaactctcttaatatgagttttcatggccccaaaacctgaagaatttcaggtgatgtcgcatatttttaatatactacctttcctttggttagcatttgaatgatgatcttcttttcatccttttactttagcttatgttttagatgtgtctcttgtaaatggcctatacagctggattttgtctttgacatttttaacatgcatacctaaaatctaaagctcatcaatgttcctatctttttcccaaataatgccaggaccttagaagaattttcttgcctatcacctcttctttcttattttagaagttatggtacccagtatttaaaattttttaacatcacaaatcgtatgtttttagtattttttatactacttttttactcagatgtcccctctggaattcttattcttcctgaagaaatattttggaagttcctatcacagatgtctgttgacagttaaaacttttagtttctgttcacttgaaaatgtctttattttaccatagttcttgaatgatagtgtggctcgttgacagttattttctcttagtatctgctcccattattgctgtctataattttgctttagtataattgctgataactttgtatataacctgccatttctctatggctgctttttagattgtctttggtgtgtttcagttcactatgagatgcttaagtatggatttttttttttttttgagatggagtttcgctcttgttgcccaggctggagtgcaatggcgcgatcttggctcaccacaatcctgcctcccaggttcaagcgattctcctgcctcagcctcccaagtagctgagattacaggcatgtgccaccatgcctggctgattttgtacttttagtagagacggggtttctccatgttggtcaggctggtctcaaactcctgacctcaggtgatccgcctgtcttggcctcccaaagtgctgggattacaggcgtgagccaccatgcccagcaggtatggaatttttaattttaacttacttggaatttattatgactcttgaatctgagaattcatgtcatttgtcaatttttttaaaattctcatccattatatatttgaatattttctctcccctctttcaaattctgatataaaactttttattttatgggtacatgtcttttaatatcaccttcttgttttctatgtgtaagtgatattctgggtaatttcagggccttcatcaatttcatagtttctcttcagctgagactacttggctatttaacctacctatttaaagttttaatttcagtgataacatctttcacattttaagtgaagttgtatttttgttctttttcaaatcaatctggtcttttaaaatcagtatcttgttttatgcttactttttttattctagtcttttaatttaagcacacttagtttacattctgtatttagtaattccagtgtcatccttagcagtctaaatgtgtgttgctttggctgacttgctaatggtgattagtttccatatgtgttttgaaatttgtattgtgagttcatgtttcactggtactttttttgtggaaatcctttaaggcctctgttagagtaagtctatctatagagagtttgcattagcctttattagctctggagtgactgaaggaccactttaagttcatttctcatttaagggtagaccacaatgtttgtaggtagacttatattaagggcatagtacttagaaggtcctcacattatgtaggggtctcagttccagttcccctcattttgtgagatcaaattgtttcaaagttaaaagtctaagttatgagtcagcagatgctatttcagttcttaatgacctctgaggcttcctgttccttctttcttttttggtctacaaggatttcccttagtttttggggagattacctgcacattataaaattatattttttatacttaatcagcatttcttggtattttatagtggcagtctttttgaagttgtgtatttcttcaccatagcaggaacaggagttcttccattttaatccatagatcctttttctagattcttactttttggattatcactttttaccctagtttctccactctttaaagctagaagtaagctattattattagcaccatttttatttctggaagagccaaattttcacctggtttttgtttcctgctttttgttttggcatcttgtcaaaaccattatttgtgttaccactcttcaataatcctattttcttcctggctacattctcaaagggcctaaatcaaatgaaacttttatcaccttcatctcttctgcatacatgccctgttggccactcccttcttgatgtatttttctctcctgacttctgagctgcctagttttcccaattttgcacctacaaaccttggtcctcagttctagctcctcttctgcctgcctctcactctgctctttttgcctcttttcttatattctgttttctacctgcctggaatctctgggttatcggggctactttcatctctcagctattatctatattctacatatctgcagccccagcctcccctgagcagcagctctgtatatttgactgcctactcagacccacacacagggctcacacagccatcatttggcagcactgacttttttttttttttttttggggacagagtctcgctctgtcgcccaagctggagtgcagtggcgcgatcttggctcactgcaagctccgcctcccgggttcacgccattctcctgcctcagcctcccaagtagctgggactacaggtgcctgccaccacgcccggctaatttttttttttttttgtatttgtagtagagacagggtttcactgtgttagccagaacagtctcgatctcctgaccttgtgatctgcccgcctcggcctcccaaagtgctgggattacaggcatgggctaccgcgcctggccaagcagcattaacttttttgccagaagttctcatctacaggaatggggaggtacatcgtccttcttcagaatattacaatagaaattcactgtagctgcgatacactgagaatcacagacatgtcctgaaaatgacccctcctggatacatttaaaagttacaataggtaactttaaataggtttttatatattttttctcttacaacttaacaaagtgaaacattaaatttgttctttgaagaaaaagatatcaccaaggtgttgatggtgttgaatgttagaccctgagaggtcttgttttagggtggaatcctgactgccttttggtgaaaggaaaaactctaacagatgctaagaatgcaccatagtacatgtggtgccccataaagagatgacaaaatcatgttcttacgtgttgaaaatgatatcccctaaatactgttaagtgaatgtttcacttatggaaatgaatatttgtgtgtgtggtttttttcctagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatata

SEQ ID NO: 5642 - DNA, 18030 bp, human
gaccaaagaagcagagatagataattcttcaactgtagaaagccttggagaaactactgatatcttaaacatggtaatgatttcctatctatttatctaaatatgagtttgaattttagttcattgtgtatgtgaatgtgtgtatacttcctatactcttatatgcatgaaagcgtctttctcgtttcttactttattttttaaccaactatattgaggtataattcacatacaataaaatttgttttgatcctcacattattagtatggcaattgagagcggattctattactatctgaactgttttcccttcattttatatatatatatatataaaaaaatatatataattgaaaatatactatatatttgtactatatacaaatatatagtatatatactgtattctttttataatatatattttttatttatttcagacacacatcatgagcctgaattccaatgaaaagtcattaaaattatcaccagttcagaaacaaaaggtataatatgaagatttattttcgttattgttggtgagagcagtttaagttaattttttggatggtttttggaaagaacacaagaaacgtaagcatttacttactttagaatttaaaagacagagggatacaatgtagataacctccattttgccttgttctgatggtatgtattttctgtaaagaaacaagagtggaagcattttattgctgaaatttgctctttgggatcattaacttaagttataatagccatacttttccttctgtcaagccataggttatgattgcagttcttatgtataggaaaagactaccatttattgatagagtggccctctgactttggttgagtatgactttgaattaattactatgctgactttactgaatgatattaatatcttttttagttttaaaattttgtgattttagtgaaaatctttgataaccttttccaatatttggttgggctttaatttatcaagaaattgatagcataaaaataaaattaaacatttggaaattagagactgttcatgggtaggaaagagagacttttaatgaataacaaattgcaaaagaagggaataggctgtggttttcacaaccatagagagataaaggcctgccctgaaatcctttgcttttcctggctttaaggactagtgcaatgaatgaatgagggattagaggattaggaaagtaaattggagaaatgtaagttgagggaagaagtctataaaaaatatttagtttctatttatagtgtctttgacatgttttcaagtttaaaactcttaaaattgaagtcactgaagtgcaagagaatcatactaaattgttaaaatttagagctagtcctcattcgttctatctataatactgaaaggcatggtgaataacagcattcctttgaatatgggagagctgttcgaacacagttgtagaagctcaatgaatattgactgatttttgactgaccatacttccaagcagacacctttcttgtgtctttccttcctcttcccttagactccaggctctccctcttctgggctgctttattgtgctagggaaagaaaggcatgtgcctttagaaatcagttctggcaactgggccttcctctcttagggctcttaaaagaatcatgactttttaaagagcaatagcaagaacagccagaaacggaaagcaattccttttaagctgacatatattttatactttctatagtctttttaagtttaggccctaccaggcctactttagtaaatgagaaaagatttattatactatttctgtgtattaacttgttaatttttaacttgtcatgttttaataatttctttggcacaataggaacctcttcctaggcctaactcatcacaatttataaaatttgaattagtgaggttttactatccagagacccaaattcattagatatttgcatccattagcttgtttgtagaatttagatcaacaatttggttttgccttattttgtccagcaggaaattaattttgtattgttaatgtattattcaaatgtcagtgtttgatttcatagtttttgtacaaatcttacattttacacttaatattctttccttagtgttctttcatttatagaaattattgtaattaaataatataatcaatgcaaggaagaaggtcaaaaatttgaaaactcatgaagattttgtttagaaaagaaaaatatattcattattatttagtttatagataaaaaacatctcatgtgcagtttcttcagttctaggagtggactattcatttttttcaaattttacatttttatttattttgtgaattttgtggactcaaaagacaaatgaaaatttgaaaattaggccaggcatggtggctcatgcctgtaatcccagcactttgggcggccaagatgggcagatcacttgaggtcagaagttcgagactagcctggccatcatggtgaaacctcatctctactaaaaataaaaaagttagctggatgtggtggcatgcacccatagtcccagctactcaggaagctgaggtgggagaatcgctggaacccaggaggcagaggctgcagtgagctgagatcatgccactgagctccagcctaggtgacagaatgaaactccgtctcaagaaaaaaaaattgaaaattaaagatgatcgggaaagtgggaaaaatatactaagctgtactatgtataagaaaagtgtacatttttttctttgaaatggaatttcgctcttgttgcccaggctggagtgcagtggcacaatcttggctcactgcaacctctgcctcccgggttcaagcaattctcctgcctcagcctcccgagtagctgggattacaggcatgtgccaccactcctggctaatttttgtacttttagtagagacgggttttcaccaggttggccaggctagtcttgaactcctgaccttaggtaatccacccgcctcggcctcttaaagtactgggattacaggtgtgagccactgtgccaggccaagaagtgtacatttttaaatagcatcttgcaaaattaatctcgaagttttatgtaaggattgattcggattgagaaaagaggcagagagtaaatattgatggtattgtgattaatggcaaaattatggcaggtagtaagaatcgaaaattaaacacagatacatgttactaaatcaaaattagatgtatcacagactagagagtggcacaaatgatccttaaagaaaacaaaactttagcaaaatatctggtaaaacttgctattttgattctcctaaacttataaaaatgtaaaatcttggcagtatttaaagtagataagttgtccttgtcaactaatagtagtatgacatatgataattacttcaaaaaatttacagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgtatatagtcagaaattctttatgaaaagataaactgtctagtattagatactgaattttagagaggctagatttccactagagtaatttcaattgtcccttaaaattttccgtgtacataatgcagctaatttatctgatagtttatttgtggctcctttttcaactaatttcctttcatagtcccttttatatcctgggcatgagagatttcttatacttagttttattaaggaggattttgatgagaaacttcctgtgagttttgtgtagttgagttcttttgcacagttgattctctgagtgagaaagaatatgaggaaaaagtctagaatcgtatgaagtaaaggatttcctaggagcaattgtaagttttgccttagctgcaaggatctctggcagcttcccctaactaaccaaatgtactgatttggcattgcattgctttaccgaattcgaccacattcattaagggatagtagaaaagaattaatactatgataaaaatatatgtgccgaacatgattatttaaaaagtagatttaaaataattaagatggatgacacagaattcataaagaaaaaaacctccagggaaatgagaaactcttaaactcaagttattaatgtaatagctatgagcattcatcttctactgaagagataatcagccagtaatacagaaacaacgttctaaaatacacccatctcagtattaaacctggtctatatgtccacgtttaaatagcatttcttcacatttccctggccaaaaacattttgtgctctttagaagtggtagttcatgcaagcattgttttctagtggagaacactggcctccctagtcactttgagaccaaagcccttcttctggttttgtacttttgagctgtctgaacttgggctagtctcttagctttgcagtcctcaatttcttcatctggaaaattatagaatgagaatgagtgacctaagggattctataggaacagcagttgttcattaccagctagagctctgtcacacccagattttctgcaattcctttttcctcaataaaaaatcttaagtctcgtcaccaaagcgaccccacattcaaactaactagtagttatactaaagtaaacagttatcctaaactactaagcacacactaactttctgtgcccactgttgggcgaacatttatttaatcacatgtggcaggtctagtaccctcaaaaagtttatggagaggagtgtattgtgggttaggggtgggttggggtacaaaagacccaggtctatccaggctttcatcgacagaagtgatttacatgtttgtaaattttatatatcttaggagaaaaaaaaggaagcttaagaatgagaccactttgtccctcatgaattaacacttggttatatagattaaaataactggttccttctttattgttcccatctgctggttgttcaggcttttatagtagtttattactgatcattattgagggaagtgtgagtagtatatatagaatccattgagttacatttcctaatgaggactctggctgaaaaagactttaaggtaagctgcaaaggattacctaccacagaaactgctgctgctgctgctgctgctgctgctgaacagcagcagtcaaggtgagtgcaactgaaatgtcttctattatttcactatagagaaacttgctatacacttacatagcaaaaataaaatgtgaccatggaagaaggaaaggccaagcttttcttgtttctgacctggagaactgagtagaaagagtactattcagcaagatcgagaataagggagcagaagcatgtttgggagacagttttttactgttgattttagattgtaggagatgttcaggaggcagatacctgtatggatctggagctcacggagactgctgagtatcgccagctcatagatgtagttaaaactggatttgactgaaaggaagtgttcctaatgtgaatggaggagagttgaagacagaattcagagaaatgtcagtaggtaagggagaggttgagaaagtgaagtctgagaaggaggtgtgggagcatacttactaggaaagagagataccacccaagccaaagaaggggtttcagagaggaaggagtggtagtagctgcagagagagcctctaggaggcagcctagtagagggccaggggcagaacccacattgccaggaaagaatgagctccgggaaatctgctctgcagaggaatagaatcagaactgtgaaaattaaatatcagatatagatatttaatttttaaaatatttaattttttaagcatatttctcaatttaggaagggagatgtgtactccagagactttggttttctggggaaaagatgataaattttgttcataattaatatatacataagaatagagtgttattgatgtgagcttatgaaccaaaagaaaaatctgcaatgctttaaacattagtgaggcggagaaaaaaaacatctgtgagaacagccattattatcctcaaattaaatgagcaggtttggaaacaaacatgggctccaaagtccagtagaactgagttaaaatcccagccctccactgatgagctgtgtggacacctagaaaagttgtggtggtggtggtggtggtggttgttatttgacctttctgagtcttatttccctcatttgataaaggaagggacttttgacgattaaattacctaacacatgaaacatgttataggcactcagcaaatggtaacctgtatcactctaattatactctgtgatcacaccaaggtaggtgcaaagctacactcatgaatctccaggtcactgactgatgtgcgtgagtttagtcatgtgaacctgacttttgtttaaatgtaacataatagcaaaatataaattggcttatagaaatagatctgtgggaataaagtagattgcaataatgatcatgcttaagtataaggtggagtgaaactattacacaccatacattagtcaataaatgcccctaaatatttaaagtgtgttgaaacgctgatcacactcatgtggttagccgaaaatttaggtgtgttttctgtcactgaacatttccctctgtgtcctaaccttgttatcaaaataaataaaaataattagcacataaggtatagtcgtggatcatgcatttgtttatggacaacaagaaaatcttctaaggaaaaagagtagagatagtaaagaataaatctgaaaatgagaataaaaatgctcgccagcaagatattctatactctgaacatttatttctgtaggcctgcctatcaaactggaatgtattcagtggtgagaatacaggattaggaatgacataagggagtggtgcctagaaagaaggaagagtttaagagattataaagtagtatgatcagccaagaatttggagatcacaactggcagcccatgggtgcagtctggcctgcagacttattttgtttggtgcagtttttttttatttaaatcatattggttgccaacattgaaatgtcaggagattttacatttaaaaagtttctcagccaggcatggtgactcacacctgtaatcgcagaactttgggaggctgaggctggaggattgcttgaggccaggagttcaagaccagcctgggcaagatgataaaaacctgtctctacaaaaaaattaaaagattagttaggcatggtggtgtgcgccctgtagtcccagctactcaggaggctgaagtgggaagatcgcttgagccctgaaggtcaaggctgtagtaagctgtgattgtgccactgcactccagcttgagtgacagagtgaggccctgtctcaaataataataatgtttcttggacttttggaaagcctgggtctgggagcatcacactgtggcaacactgacctgaagctgagctgaggctggcacccctctccccagttcccatggctccttccctcactggccttgatgctaggctcctggctcacaataaaaggatgtatagaggacacaaaaataagtggacgttttaaatgaactattttccagtgataagatctgggacattatgggaaaaaaaagtccaaacttactgtttttcgacagtcctcaatgcacactaagaattctatcttactttttatggaggggcctctacaaaattatttatacttatatacaaatatatagtatatgctcatgttatttttctctgtaaataatctttttaatctttacacaaaccctctgaggtaggtattgctaatgttatttttccattttacaggtagactataaaatacattcactgggtgccatgctcaggccatgagtgattagattaaggcttggaaagcagtgcttagggctttgtatttaatgcccttcccaccccatactgctgtttccatgattttcagtgtagttaaaacatgaacttacaggttaacttttcctgtccaaaaaaaaaatatatacttgaaattttgatttttctacctgatataacttaaatacaaagttttatgctatattaacctatctgggaaacattttctaccctacatgacattgaagcatgtcagaaattctgaattatagcacaaaattttatactttatagctctggtttgttttattacttttaaaaaactataatacccacggacaaaagtgcctatctcatacatgtgtccctcaatatatttttcacaaagtgaatacacccatcacaaactgatcagcatccaaatcaaggaaaaacacagtaccagctccctcagaagcttcactttaacccctttcagtcatttcccactctcagccccaccccccagcccccatcccagcattctccttaaagcatgcgatgtaattgtgttcttaagtaaacagaaacctcagtaggaacctttgctctcttgttctgttccttaagaaatatgaaaagtgttgccttgggccagaccagagtctgcacctgactgtgccatgcctgaccaatgaaacaaagggtccttttgtgagaggtcaggcccattcacttctttactgtgatcctaacgcaagacacagacatatactgaccatttcagactacctgtttacatcttcttagatggttctagtgccaagaatgtacttaaactttactctttctttttataaaatgacagtattctgccagtcactcccaaattgtttcagtttaaaaggtaagtgctttctgtgacttcaagtagtcgtccagatgtgtttagaataattttaaatgtgcttagtctgtgagtgctatgatgtgatttctagtgaaaatgtcattttctaatagctttctcaaatttagaaaatgatatagttccaaaagttcttcattgttatagattgtttaaagttaatgagtaaaattgtagtttgttatgagtgttttacttatttctaaaataaggtaaaactcccacgtgtctttttataatagcatgacattatcctgtggttacatgaatacctcagttaacaagcccagttggagttgacccaggtgctaggttagccaagcttcccaagtaattgaggattatgctgggaacacagctcactgatccctccctctgtgaaaagaggggcatagtctgaaattccttgtctcaggagcactgttctttttagttaacctttcatttatgtatatttatgcagacaactatcagtcataagtcttaaatctagtaatcttcccattccctttcaaagtgaagttgtttctgataattttagctacccataatgtatacctggctaggcatgatacacaatataagtcactcaaaaggggaaatcaggctgggcgtggtggctcacgcttgtaatcctagcactttgggaggccaaggcgggaggatcacctgaagtcaggagtttgaggccagcctggccaacatggcgaaaccccgtctttactaaaagtacaaaaatcagctgggtgtggtggtgggtgcctgtaatcccagctactcgggaggctgaggcaggagaatcgcttcaacccgggaggtggaggttgcagtgagccaagattgtgccactgcactccagcctgggtgacagagtgagaccctgtctcaaacaaaagcaaaaaacaggcggttggaatcatgcagacaaaaacaaagcttaaaagtaaatgataactacctcatgttaaccctacccagtctaatcaatcatcatttgaaatagctgtctgccctggtaccatgttcctttctcccacattcctctcttgcatacattgcctcatgaccttggattaacctaaatctaattcttcctgagtagcttctgaaactctttttaaaatctcaaagctttatttacttagggcttcctgtcctcagtgggaatgctattaggccacgcctttgcaattggcctgaggatgacactaatgtttactattaaggtgtactgtataaacatcctcttcctagcctggactctcgcattttatatttttaccagaagaaaggtgagttaaattttagaggcattattttccaaccacctactaaagattctgttgagtatcagtcaggctttatccttagccagacagctactagaaagctgaccatcaaaagctaattacagtgttgaaggggatatggtctgaagcaaatattgccaaggtgaactttgtacaaatgttatttgaaggagtaaatggcactgataactgcttcacatattttagaagcagttataataaacttaattataataaactataaagttataactttagtgaagtgtgtaaatgaaaagtatgggggggaatctaatgagaaacctaatatcttaatgacaatcagagtatttcacccaaaattagaaagttaaaaaaaaaaaagaaatctcagtgtagaataaaggctgaaactaatattttctgcctatacttaataagcattccatgatttactatcagtctatcaaatccatagacagcctcttttatcgtttggattagctggccagtagccagacagaacaagttctgcctctgtttggttttccttctgcttttaataaccatgagcaaaccatttaaactgtctatgttcctttatcttttttcctggaatgtaaataattatacttatcttcctcatgactgtcagtgaatcgtacttctgaagtgattctaaatccctatattttggaaaatgaatataatatatagatatgattatgttataatgctacagtagacagaacgctttttaaacttttctcaaggttgaaagcattgtgagacaaccaagaaagagtatttattttttttttccattgtaaccttgccatgggtgctagtaagaattttggaaatcctagtcattgaaatagagtggcatgcgtaaaatccttgttaatacagtaacttgatattcagcatggactgtacagtatttttttcttcggcttcaatatttgaattaatattttcctggtttttttagatgacacaaattatttatgacagcaatatcaaatccctcgttttttaacaagaaaatcttactcttctctgatggtcaattttgtcacaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaaggtatgatgatagatgcttaaatcctgagatcctgggagaaaacatatgggttctctagtttctgcagaggacagattccagttgcctttgggatcagaaatactcccatgaatacatgaatacatgaattcatgtgccataagagaaaggctttggcttatttgtgaactaagcaaactttgtctctagcacactttctagaatgctgcttggtagcattctgcctcccgcatgagtggaagtagaatggtatgggccaggatagtacaccgttgggaaattaaccaagaagttcagcactcagtccttgaaatgctgaaagtgcaaagttaggagccctggcactggtggcagaaatggggtgtgtatgtgtacacacacctgtgtatgtttacatgtgtgaatgattgaaagttggtcacagcagtatttgaagttgtgatcagttcttcaaaggtgcagtctagacaaaattatgtatagaaggaataggagaagatatcactaaggaagcaaaaatcaccctgaaagtggagctagagaagcccaaaacataatctcttccattggcagttttgactgagagtgaccttgctaggagatagtttgtaggtttgaaatcatttgtttgctaacactactctggattaacttcagaagtatggaattccgcaacccaaagtgaatgacgttgtactgattcatctttattttcattttttgaacctctcatgcagaacactgagtcataccttctagtatgaaacactctcatcattggtctgttgcaaggctcttctcatgtaaatgtattctcttttagctccattccccttcccctttttccctaacatagacaaccactgaaacatatttgtcattttatttgaatgtgtacttgtgaaacatgttttgtgtgcatacatttttaatttacaaattggtattgtggtaaaggtcattcttttgcttggttccttctttatccaagactcctttctctcactaagaaaaaaaatattctagcagttactgttttatttcagaaggagaaaatgattctgtttatagggaacatttatgaattcaggttagggtggtccttaagattatttaacatagaaatcattaaataccaatttgacattgtaaaatgttgagacaagttgtatgccaattagcgttcatgaatcttctttgaggagaattcttgagtcatacagtttttttaatcacacaattttaagctaggaggacatttgcaatcagtcagcatctaaggcccctcactttacaagagctcagcaaagtgaagtaattgtcacatgtttatgtcattagctagaggcagactctagaacctgcttaaagattcagacttaagttttctagaacagcacaaaaatattttttgttatattgctttgttattgtttatagaaagaaaaagccaacctagaggaacgggccatttgtgagtacaatgaaaacccaaaaggtatgagcacatttgataacatacatatatacatacatacatacacacatatatatgtgtatgtatgccataattgggtaattataagcttacatataagtttacatatatgctataatttttactgtcacatgatcctcataacaagctatgaaatatgtgatacagacttatctgttcttatatataaccaccacagcttcttcacatacaaatattgcattattcatggctacttatgtgtcaatgttaaggaattttttatttttttttgagacagagtttcgctcttgttgcccaggatggagtgcaatggcacgatctcagctcattgcaatctccacctcccaggttcaagtgattctcctgcctcagcctcccgagtagctgggattacaggcgtgtgccactacacctggctaatttttatatttttagtagagatgtggttttgccatattgtccaggcgagtctcaaactcctgacctcaggtgatcctcccgcctcggcctcccaaagtgctgggattacaggcatgagccaccacacccggctggtgttaaggaatttaagtagcctttttactaccttttttctctctattaaatcagtattattaaatcaagcttttgccccaaattccaatttatatctctagtgcacactgctagactccattgcccaaccaagttgggactactgggctggcctaaagccacaatggccacccagttatttacccccgagggctcagacctgagtgtcttaccgtagatactgaagagaagtcctttcccaagcctacctatcagtgtcagagagcaggtgctgtggaatagaggagactgtgattgcccttgagatctacataatctagacacaaatcatctgtgtttctgtagtatgactcccacattgtttccacaccatcacacggcagtatgattgtgttctcataaaaaaataactatctgtaatactggatatctgatctaaacttaagctgaagaatgaatagtttccttaatcctgttccttttaacttctgccataagagtagtaagttttagaatattttaggcaagtgttaaaaaatgtatcacctataagtattcttaacatatagcctaaagcactacaaagaaattaaatataagcttaaaagtagttgataatataaaattaaaacaatgcatatgcttcacaagtatactttgaagataattattcagatatagaacatgtggattaatttgaaacaccaaaaaatagcatgtccatttgagtacaaagaatgtaattataactaggttaatttttaaagtaatttgtattttacagaagtcttctctaacattgactattacctttgtagctatatttggatactggtcatctaaacatttacaactttggtgaggtcattctgggcttttcactttaactcaacttttcaggaaatatgcagtgtagatgttgtccactactccaggggtgagctcttttcgtattaccccacaactcagggttcatagagtttcactgagagcatcaggtcttgtctttttcctattagttaaaactagtatttctgaatgatccaattgtaggatacatgcttgatgatgcagatagcagttcattagaaatcc

SEQ ID NO: 5643 - DNA, 127544 bp, human; identical to SEQ ID NO: 3332

SEQ ID NO: 5644 - DNA, 126627 bp, human; identical to SEQ ID NO: 3330

SEQ ID NO: 5645 - DNA, 126627 bp, human; identical to SEQ ID NO: 3330

SEQ ID NO: 5646 - DNA, 126728 bp, human; identical to SEQ ID NO: 3331

SEQ ID NO: 5647 - DNA, 126728 bp, human; identical to SEQ ID NO: 3331

SEQ ID NO: 5648 - DNA, 126854 bp, human; identical to SEQ ID NO: 3334

SEQ ID NO: 5649 - DNA, 22819 bp, human; identical to SEQ ID NO: 3352

SEQ ID NO: 5650 - DNA, 2906 bp, human
tgcacaggcggaagcgggggagggcgggggacgccaggcctaaagcgcctcgtgggtttagagaactcagagagggcaccgggtgggggtgggaagaagactcaacccgtagctaaatgtttggcctttggctattttttaaggaaacgaatctcagggaggtcggggcgcgggggatgggggcatcatcgcgcctcggagatgggaagcgagttcccctccgctttctgggaaaagccttgtctcccttctttcccctccccccatcctgctgagggtttgcgttgacccatctctccgctcgggaccggcaggaggacggagccgcaggggctgaccgcggcccagaggctgcccaggggtcgcgctgctgccggcctgcgcttccgcactcccgggttcggtgcgtcgcctctcgcggcagcgcctcgcttcttccagactgtaattccacactcccgcaagcgctggggctgcggaatcgtttgagggagttggaactgcatcagatgagcacgccgggaggtgagatcgggtaggaaatagccgaaactttgagttgtgcgccaccccaccgcccccaacacacacacacaggcacacacacacacacacacacacacacacacacatttaccctcccccttcccagccgcaacctccgccaccctctcgattcttcaaggtttgcagcccagtcctgtcatatggttttgtttctgtgctgctgttttttttcagacacgaaaattggacacgtggagaattagccctgctggagaagcgctgggtgcagactcaaacaatggtttccagcgccgaagctgaggcatcaccttccccacctccaccctcaaatggcagctgcctctatatacagcgggcacaccccttcactacccaccccctcccccaaagcctggttagggacctatgtgggctgcacgctctggagccccttgcccggacacaaaccctaggtgggcctgggctgcccgctgagtagctcattgcgcctgggatcccctgggatttagaagtatagggctctctatttttccctaggaaggtcctgtctcaaagatgccacccccaaaaattaatgtgtaaaaacccaaccaagctccagtctctgtgtcctttggcaaatctatctttcctagggcatactttcctaagctgctgggaccttgccccccatctgatgagccatacgcaggtggtctggcctcttcagagcagcttcctttagttattgtcttctccagaggccccatcctccacggcagccctaatcttagccccccagcctctctgagcccccatcccacccccacactgcgctgagctggcagcagccacagctcccccaggcagttcctctctcactgcgcggcctgtgcatctcgctggggcacacactccgcacagaagctccctcgcctcctggagctggtttcctcttacaggctccccttagagctgctggtgctgtgacaacgcctgcatctctgtgtctccctgcagcgctgcgagctgtgaatctgccttctcttcccttcctgcaaaggtcaagctgcctccttctctcgcagggccgcagttcagttctggcctgcagagcttctacactgcaacttgaatatgggaatggggtgggcatcgtgcaagggagcagtcacactcaagccaggaggcagggacaaaagggtgtgcgattcagggagggaaacactgaggacaaccctcagaaagcagtgcaggatttgcagctaaagactcaaaagagggagagaaaacgaggaaaaggctgttactaggtcgtgagtcctgaagtgtaggcctttctcctcccaccccgtgggttgccctaggggaaggccagaagaggcctcaggtgtctgcactgtgtcctgtgcagttcctagggccatgcacttccggtgaggctgcactttactccaagcaggagtcagaagcatggaattcagtggccgcaggagctcaagtcggctgcagccctttcaaagagggaccccgaagaggcctttctgccaccccagccccagagaggctatgaggctctacaagcagcagagagaatgatacggagaaaaatgagaggaaacgctattaaacttgcttcctctaaagagcgctacccaccgttttctctgaactgtacctaaaaagtcaggagagaactcgttaacttttgtttggtttaacattgccagcttcaagtcaaccgtaggccccccgaaggttttgtaaaatatttaatctagctcagacaatttcctgcagtccctaaccagaccaccccacttactgagccgctgccaaaaaggatgcttgactgcagactggcaaccagaggccttccagtcgcctggctggccttgacctccactcgaggcgccaggaaagacccttcccggaatcccgagagaccaagacctgggtaatcctggaggtctaaacccgtgaggaagcccaagaaatggagttaaagacccttttcgcacaaccgattgttgtctgtgtgaccttctgcggcccttgccctctctgaaccctctaaaatgggcatgaggatgtctcaccttcctctgggtgttatgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggct

SEQ ID NO: 5651 - DNA, 16811 bp, human
tttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcaggtgagccgcaagaaccccaccgggctggctgctgcgtgaattcctcccctgacctaacctggctaatggcgcagcgctaaccggcacccttacttttcattttctgggtgccccgggctggcgggtgtgagtgccccggggctatagagggataggaatgttggttggggctgtcgcccgggcccggtctcggcccgctgtattgtccccgggacgagcacaatggcggcttttgtgtgtgcgtgcgcaggcgggcggagggggaggaagtgcgcgcgctctcgcggggacgcgcatgcgcgaatcccgactgattagtgacctgggggggtttgcgggagtgcgcagcgcggcgggacgcgactggaggcccttttggcttggagggcttcggccttcacggctggcgcagcctggattcccgtccggaggacctggcggcacccggtgtttgcgtgcctgcgagcaaggggtagaacgcggcccaggaatgtgggagggggcggccttcgctcggggtaatggcggcggcctcttttgtgtggtgctgggcggcgctgtggctcacctccgggagacggcgggtctcgggcgggcgaaggcctggaaaggaggatggaatgggtttcttgttttttcccgggttccttccgctggctttttcgcttcagcccaggttccgcagggtccgggggccctgcgccgcagccggggaggctgcgtttccggagtggaaagttttgtgacgcagaagattggggaggagtgggggaggggtgggggcggggaggggaggcaggaattggccgctgcgcgctgggccctggagatagaggttggacgtggcggggaggttagggagccagcgaggccctttctcctccttgcttgccccagattgtccctgtgtggtatgttagccgggagtcccgcgttgtttttctggggtggaggggtcatcgcgggttgtggtagtgtcttcgtgttagtgactgtgatccaggaatccgccattggaaaaacacccggcttaggggggaagtaaacagttttgttgttgacttgttgctatctgtggagtagaatcttgcaatgggtcccaggcccccgggttttttctcttagccagaatcccctcttctaagggtttaggggcagaggagagaaagatgtgtgatttgagaggagaaggttatggactttggtggcaggaagtctgcatcccaccgcaacagtggcaccaggcttcagataagctcttgtgtgggttatgcggagcttttaaataaactactgtctactgtgattaggggagcgttgatttcacaaactccggaataatcctgagacgaagtttagtggcacaaattaattgaatacatagtttaatgtagtcatatgtaatattttttaggaattgatctgttcctttggaagcattttctacccgttaatgaaccaattatattaaatcctctaattgctgacacatgttgaattgaacagacactttaacaacctaccagcagcacagagtattcccagttttaccattttccatttagctatagtgtccttttaaggattctaggcaacagtgaaccttatttaaaaagcaaaattgtgctataacaagtgcaaaaggaaagtttgtgttcctaccgtgctttaaagtattgatggtagcaagagaaagcgcagtggtgtttttgctcatagaaattctggaaattaggtgcctgaagtcttacactcattttttaaaagtatagcatctgcttccagttttcagtgactccattgatgatgcatgcggtttggccgtatcatactgagctttaaacacaagatttataaacatggtatgtagtgcatcttttgcaaacaggttggcagcggtactgtgtgacttggtcttttgtggcttttttgagaaaaatgaaacactttgcatgtatagttttttctcccaactacttgtgagtagttcctggttataaaacgttatgaaggtagcacataacccttttctagaatgaagaggcttttgagctaccagtgtaaggggataggtagaaatagagatgaaaggcactaagatgtcctactctttaagagcattgaacgccagttgtgccatttattcaaagtcatctttgaacttatgttaaaatggggtaaaaacaggtaactacttcaggccgggctcatgcttgtaatcccagtgctttgggaggccaaggcaggtggttcacctgacctgaggtcaggagaccagcctgggcaacatggcgaaaccccatctctactaaaagtacaaaaagtagcctagcgtggtggcgcacccctgtaatcccagctactcggggaggtggaggttgcagtgagccgagatcacatgactgaattccagcctggatgacagagggagactctgtctcaaaaaaaataaaaataaaaacaaacgaaacagtcaaactacttaagagttgtgcttaacatagtgttctgtaagtggtaggtatattgctatttttttgttgttcttaagagtactacccgactaaaaatacttgggcaatatttagggatgaagtatctaactaaaagaacggccacttcgaaatttgtcctgacatttttcaggtgtgcattttaggtttaaaatatcaagtattacggaaagttggcattggaaactttcataaccggcactaaaacgaatcctttatctatttgacattgaggaataattttgagattcagtgtaagctttagtttggtgattagggagcctgtgctatggaacatgttagtgaaaatttattttgaatgcatgaattaaatttggacagtttctactgaacagcacaagcatcttggtgtgccgccttctgtagtatatacaatagtaatattgcatttgcttagagcattgcagacttgaaaacattcttagtcacattctcattaagggttggtattagccctgtgaggtggactgggcaactacttgaatgcagtactagcaaatgctagagggcaggactagttttctcttaatgtagtatttgagcacatggggtgctaaccatctcactctcttctagtttgctggcctagacctgaactcttcagataatcagagtggaggaagtacagccagcagtaagtacaacatcttgtgggtttattgaatattagagcttaacatcttaagatttcattgggcttatgtaaaatttaagaaatttgcctttcaattttttactgcttaaagaattatgtagtctttgtgttatagaattatgtagtacttagtgatcaatctaaagcatcgttgccttttttttttttttttggttgagatggagctttgctcttgttgcccaggttggagtgcaatggtgtgatctcggctcaccgcagtctctgcctccgggttcaagcgattctcctgcctcagcctcccgaatagctgtgcctttctgataataaaacatcaatgactagctggctctcttgagtaaaagcagctaatcattggaaagaaccttattatatcaaattatctctagaagagtttttgtccattataaatcctgagcccagtttagaggtgatgggaatgtgtccctgttaactgactatatttattaaattgaattaagggaatatgcatttcattggttatagctactcctttctcctgaagaacagaagactatactgaattttggattggtggttaggttaggttttcaaatgtgtcatttcttttaaaaaggcattagaaaagttgctttttttcttctaaggggggttatttagagacttgttagaggttagtgttaagataggggatcttggtggtttattataagggcaatagacccttatttttagctcagatctcttcctacttattaaaacaaaagtgagtatgggctatgatgtgtcctcatttttaggcaagaacagcttcactgggaacaaaacttggtgtttgctttaactttcaccttatttgtcatgctaagaatcttttaggaactgattgtcctagtagagatttttaaaaatatttaattcagtctagaagtgaaaaagaaaaatgacacgtttactagttataaagcaaatttatttggctttatgttgttttttttgcttatccatattctaggctgtactcctgctcgcatacagagcaactgtcaactttccttaaactcagcaagccccaaattaaaacctgcaattccttgaaattaactcccctttgcagcttttccttgtttatttattgtatgttttgcaacttactggcatagaaacaaaagattgtgagatatgttacatgagtaatcttaaattgttacagtaatacttaatgcttttgttgacagttttgatgacagttctcttaaatctagcaggcctttaaaaaaatcacattaaatgaccactggtggctaaatgtgctcaatttgtggatttcaactattaggttccaaatcagcttttttttatcaaactcctttcagagttctccttatgaagcagtaacccatttaaaattagattcttatttttcccccctctcagtgtccaggtaagtaatcagattggaaggctggagattttaatttcccagaaccattttttagtaacagaaatttaaatgggaaggttttttggcatttaattaattttatatatatatatatttttttagaagggcgctatattcctcctcatttaaggaaccgagaagctactaaaggtaggtcctcacaagtaacttcgtaggtctattttttgcctcctttagaagttagtaaagcctaaggaaaaccaggcatttgggggaggtctaaacatggtgttgtttttctatgcttctgtcagccttggttcaaatactagagcttaataattttggaagaactcatctaatgttacgcagtgggaaattcggcattcctatgtcaaactgttctgacgccaagggcatggttttgtacagtttcactagtgttgtgctgaatctgtttgtaatcattcacagcatggttttagtttggaagaggtgggtgccctactgtgtaaaccaagctgtataatgataacaacctggttatttctgtcttggcaaagttgctagaaatgaagatgggcttattgtagaacagttaacaagttacagcgttggaagtgattctctggtttcatctccttgccttgctgcttttgaaaggttttgtccaaaatgtattacaatatctggtgtcttttcccattgtaattgtaacgtagtgatagatgacagctagtatatgtttcatattatgagacagctgttcgggtgctttatattctgtaaaatagaccatccaaaatttggaggaaaagggaaagtcaggaaaaccaaagattaggagggaagatactgtataaagaaggcagataggaagagtggagagtccacaggggagcacatggtttgctgctgttcctccatctccatatgtagtctgtattaccttcactgtcctggcaatgcatggatataaaatctgtattatttctaccagaagatcactttggctttttttttttttttttttttttgagacggagccttgctctgctgcggaggctggagtgcagtagcgcgggctcactgcaacctccgcctcctgggttcaagtgattctcctgcctcagcctcccaagtagctgggatcacaggcatgtgccaccatgcccggctaatttttgtatatttagtagagacggggttttgccttgttgcctaggctggtctcgaactcctgacctcaagtgatccacccgcctcagcctcccaaagtgctgggattacaggcgtgagccaccatgcctggctggcattatattctttttaggggaggttactttggaatttgtctttatcatcatggatgttctcaatattcctagtatactagctagaattgaccctcgtgtatatggcagtatcatagaggttttagagctggtagagatctggcaatctaacttaactctttcttgctagcaaaggctgttggtcacctgactggcctaacggtaggaggtagaaggcagaaggaaagtaactgaattgagaagctgtttctgtttaataaggtgttgctgaagctagttaaaccctctacctgtctttaaaccctctacctgtctttgggttaatttacatgtttgtcatccccttacctggatatttatagctgtacccaggaaccttgtctatactgagaatatatagtgatgagggtttttctttttcccaggtattcctgattgtcatcaagcttatagtagatgaaccactaaaataatactacaatttgacattagtgttcttgtactttatactattgaaactgaaaaatactgtattaaaccaagtaatctgacagtctatgaatgttctaaatgaataccacctccaagaaacatggaaacaatggtaactgtttttcctagtaaactcattcacacctataaaatgaatggaaattaaattgttatggtcacacaacgtcataatgcgttacaggcaaagctgttgaccacttagaggtagtattcattgagaaacattcttagactgtcagattgcttgatttagtgtaaagtaatttttttttttttgagacaagggtgtttcactcttgtttcccgtgctggagtgcagtggcgcaatcttggctcactgcaacctcagcctcccgggttcaagtgattctcctgcctcagcctcctgagtagctgggattacagacgtgggccaccacgcctggctaatattgtatatgtagtagagacggggtttctccatgttggtcaggctagtctcgaactcctgacctcaggtgacctgcccgccttggcctcccaaagtgctgggattacaggcgtgagccaccatgcctggccagtggacagtattttctagtggggagaattaaagaaaaactttgtccgggtgtaaaccagctttaaatcttggttctcttacagtgccatggtagggatagtcagtggaggctttcaaattcagaaagattgataataccttaacatggttcctatttctaattaataataaaatgtatttgtgcttttttaatcaaaggtttctacgataaagacagttcagggtggagttctagcaaagataaggatgcgtatagcagttttggatctcgtagtgattcaagagggaagtctagcttcttcagtgatcgtggaagtggatcaaggggaaggtaagtgatttcttaatcaccttacgtgtatgtataataacagtttaataagtcgttatcctgaccacctgtttggatgttaagcattatgtctgtttggtcattgtattttcttagccgtaagaggcttttactaaattgaacctgttacttagaaattagatgaaaataggaatatgctcattggcataatgaaatgagttattctatttctcgagttttatatgttctacttaaaagagtaagttcatctagtgaatggcctaatttggttgggatttttgtggactctataacaatttctaaacaccttgtatttttgattacacaagtgtggtgaactgaccccacgtgcctaatagctgtggttagtcctgtgtcctgatttttcgcaaacaggcctaaaactcttaaaaacatcttagttcaggtaaggattattttctaccttttatccaaagtctgtcacacaggtgaattgtcctttaagtgacatcctagtataactaggacgattgatatttggtgtgctattttcttgttttccctaccattaaatatatttggatgagcactttaaatgaaggttgtgagctgtgtgccgatttcaaataaaatccttattcttaattttggcatctgtgaggccttttaggctatacaactttatagaaatgtaaagattactgattttagaaaacgaggttatgtaaatgatgctggttagagagccttatttgtcaagtaactcagaattggattgttgacatccttatggttagccataacttaagtctccagatacagttctagagtagggataagaatctgataatggttaaatgatatgattctgattaattgcttgtgctgttcaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacagtaagtttttgaagtgtatgttacttgtgatgaagccttactagctagtataacaaatgaacttatccattttttgatttgagggaactcttttctggaggcaacactgggattaattttgagaaatacgatgacattccagttgaggcaacaggcaacaactgtcctccacatattgaaagtgtgagtatttttgcttgactttttaagacacagagaggttaaatgttttcatgttacattagaatgtgagatgggcttcataaagtcatgtagaccagaggcttcatagatttgtggaaaaggagaagttgagttcagtgtcaccattatgaataatttattacctaaaatagaaaatgggtcaaacataggaacaacccaaagtcttctccaatgtgcagtaagcctgggggttggtttttctcaaagtataatgtgataattttacttaaactataaactgagttaccaatcagctgttggttggttgtttccattattagtataaaacagaaatagctctagatagcattcctaaccccattgaatttcttaacagttcagtgatgttgagatgggagaaattatcatgggaaacattgagcttactcgttatactcgcccaactccagtgcaaaagcatgctattcctattatcaaagagaaaagagacttgatggcttgtgcccaaacaggtaagctcaactcataagagtaaaacatcatatttcttctgtaaaggactagacaataaaatattttattttttatgggtcatgcagttttgcagctgctctgcgctgctattggactgtgaaagaagccatagatgatacataaattattggttacggctgtattccgtaagagctttatttataaaaataacaggctttatttacaaaatagtctcagtttgctgactcctcttagaggtggagcagagaagccactttttggaaaacttaagcataaactaaaagtactaattattagtaatagggtagttaaaaaacactgtcatctaccaatgtctgtttaaaagtaatgagcaggatttgtttgtttgtttttgaacagggtctggaaaaactgcagcatttctgttgcccatcttgagtcagatttattcagatggtccaggcgaggctttgagggccatgaaggtagatgtttctttataaaatgggaaattgtagaactttgtaggtggccattgagagggctttctaaatgatgctaagacttaagtagaatgaaaaccagttttcaagtgtaatctgtaatctataaattacaaaagggaattatgttgtgatgaacttttcaaacagggtaggtagagttaacttaaaaattaacttatttcttaggaaaatggaaggtatgggcgccgcaaacaatacccaatctccttggtattagcaccaacgagagagttggcagtacagatctacgaggaagccagaaaagtaagtatgagttccagtgattattagctttttcattgattctaattaaatgttttatgaacatgtaaaaattttgaccttgaagttcataacattttttttgcttatagttttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaagtatgttttattttgtttttgtttttttgttttgttttgttttgttcttttgtttttggcagagttgcgctcttgttgcccaggctggagtgccatggcgcgatctcggctcaccacaacctctgcctcccgggttcaagcgattctcctgcctcagcctcccaggtagctgggattacaggcatgtgccaccacgctgggctaatttttgtatttttagtagaggcggggtttctccatgttggtcaggctggtctcgaactcctgacctcaggtgatccgcctgccttggcctcccaaagtgctgggattacaggtgtgagccatcgcacccggccaagtatgttaatttttaaatgtatgggatgcagtattaaagttactgcccattagttttgtggtgatgttaacattgtctaaatgttaaggctgagaagtgatgtatttcagacatctaactttcacaaaaagcttgttcatggtaattttaatgttgaaaaatcagtaacatcttggttgagacttacaacaatgatcagctcgtgggacagtcaactaggatgggctaatttgactgtgtaatcttgaatgacttatgtagtggcaagaatcctgtgctgtgtctgtaaaattatgcagtgtgaggcaccatcttaatgaatatataattgtaataacctatacaattgtatttgtaattatactaacagccatactaaaaccatgttgatttctcctcaaattctaaactcaggcttgttttttttcatgacatgacagatacttggtgttagatgaagctgatcggatgttggatatggggtttgagcctcagattcgtagaatagtcgaacaagatactatgcctccaaagggtgtccgccacactatgatgtttagtgctacttttcctaaggaaatacaggtactgtttgatgttgcaaattttatttatttagaaatttgtttatctcaggtaataataaaaattttttttctttcagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggtaacattatgaattttttattttattagacatgggggtttctctttgttgcccaggctggagtgcaggggttattcacaggtgtgatctcattactgatcagcatgggagtatttgacctgctctgtttctgacctgggcctgttcacccctccttaggcaacctggtgctcccttgcttccgggaggttaccatgttgatgccaaacttagtgtggacacctgataggcatagtacactacagcccagaactcctagacttagacaatcctcctgcctcagtctccagagtagctgggactacaggcactcaccactgcacccagctaaaattatgaataatttaattgctctggtaataacccatttgggctgggtgcagtggtacagtgcatgtagtcccagctacttggcaggctgaggctgtagtatgccatgattgcacctgcgaatggccagtgcactctcagcctgggcaatttagtgagacccccatctcttaaatgtatttggattacctttattacttttcctcctcaattcaaaacatgctgtgttgaaagcccgtttttaagaagatatatatgtattttaattgacacattaaaattgtgcatacataagtgcaaagagaactaagccatgttagtgacaaaaacctataatttttcaacgacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtatgtataaacatctttcttttattcaaattgagcatgttcaagtatttgttttcttttaagtgggccatatctcataaaagttattttccaggtagcagcaagaggactggacatttcaaatgtgaaacatgttatcaattttgacttgccaagtgatattgaagaatatgtacatcgtattggtcgtacgggacgtgtaggaaaccttggtaagtatttgattacttgatggtttcattgttttttgctgtgatgtgtgcaggaaagaacttgctaggatctaaaatacatttttaacaatgaaagtgacaaagattttgctcaaagcacttgtttaaatattacgtggtaatattttaaatatttctacgtaggaaagtaagaatagtagcaagttactttatggaagacctttgtttatatacttttttgggaactcttttaggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagaggtgaggtataaatagtatataatgaggggaatgggtgttcacttacagttcatagtgtttcctctgcatgcataacgtccaaggttaactgtacagtatttaaaaagcttaatcatcttaggcttcctagattctttggtaaggggttgtattagaatgggtgacactctgttggggaaaatatggctggatggggaattgtttgaatggaaaaattagaaattggtcattaggaaagagttaggttactttagtggaatttcatcttcatgtgaaccaacataatttttttcttatagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtagtgttaatctgtaacttcatagctttgggaagggtttttttccttttagtcatctttttcaaagcctaattaaacaatttaagttcagcactatagaaacttgatggcaaattacgtaagggaaggattgtatttaatgatggataacttcattaatttctctctctttttaaatctctcattaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtc

SEQ ID NO: 5652 - DNA, 31074 bp, human; identical to SEQ ID NO: 3356

SEQ ID NO: 5653 - DNA, 408078 bp, human
tgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaa
